United States Patent
Freier et al.

(10) Patent No.: US 12,350,285 B2
(45) Date of Patent: Jul. 8, 2025

(54) COMPOUNDS AND METHODS FOR REDUCING ATXN3 EXPRESSION

(71) Applicant: Ionis Pharmaceuticals, Inc., Carlsbad, CA (US)

(72) Inventors: Susan M. Freier, San Diego, CA (US); Holly Kordasiewicz, San Diego, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 18/168,004

(22) Filed: Feb. 13, 2023

(65) Prior Publication Data

US 2024/0082291 A1 Mar. 14, 2024

Related U.S. Application Data

(62) Division of application No. 16/344,254, filed as application No. PCT/US2017/061121 on Nov. 10, 2017, now Pat. No. 11,583,548.

(60) Provisional application No. 62/420,294, filed on Nov. 10, 2016.

(51) Int. Cl.
| | |
|---|---|
| *C07H 21/02* | (2006.01) |
| *A61K 31/7115* | (2006.01) |
| *A61K 31/7125* | (2006.01) |
| *A61P 25/28* | (2006.01) |
| *C12N 15/113* | (2010.01) |

(52) U.S. Cl.
CPC ...... *A61K 31/7115* (2013.01); *A61K 31/7125* (2013.01); *A61P 25/28* (2018.01); *C12N 15/113* (2013.01); *C12N 15/1137* (2013.01); *C12N 2310/11* (2013.01); *C12N 2310/315* (2013.01); *C12N 2310/3181* (2013.01); *C12N 2310/321* (2013.01); *C12N 2310/3341* (2013.01); *C12N 2310/341* (2013.01); *C12N 2310/346* (2013.01); *C12N 2310/3525* (2013.01)

(58) Field of Classification Search
CPC .......................... C12N 15/113; C12N 2310/11
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |

(Continued)

FOREIGN PATENT DOCUMENTS

| | | |
|---|---|---|
| JP | 2011125219 | 6/2011 |
| WO | WO 2002/058626 | 8/2002 |

(Continued)

OTHER PUBLICATIONS

Alves et al., "Allele-Specific RNA Silencing of Mutant Ataxin-3 Mediates Neuroprotection in a Rat Model of Machado-Joseph Disease" PLoS ONE (2008) 3(10):e3341.

(Continued)

*Primary Examiner* — Amy Rose Hudson
(74) *Attorney, Agent, or Firm* — McNeill PLLC

(57) ABSTRACT

Provided are compounds, methods, and pharmaceutical compositions for reducing the amount or activity of ATXN3 mRNA in a cell or animal, and in certain instances reducing the amount of Ataxin-3 protein in a cell or animal. Such compounds, methods, and pharmaceutical compositions are useful to prevent or ameliorate at least one symptom or hallmark of a neurodegenerative disease. Such symptoms and hallmarks include ataxia, neuropathy, and aggregate formation. Such neurodegenerative diseases include SCA3.

21 Claims, No Drawings
Specification includes a Sequence Listing.

(56) References Cited

U.S. PATENT DOCUMENTS

| | | |
|---|---|---|
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,840,491 A | 11/1998 | Kakizuka |
| 5,859,221 A | 1/1999 | Cook et al. |
| 5,945,290 A | 8/1999 | Cowsert et al. |
| 5,948,903 A | 9/1999 | Cook et al. |
| 5,994,517 A | 11/1999 | Ts'o |
| 6,005,087 A | 12/1999 | Cook et al. |
| 6,005,096 A | 12/1999 | Matteucci et al. |
| 6,166,199 A | 12/2000 | Cook et al. |
| 6,255,051 B1 | 7/2001 | Hammond et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,250,289 B2 | 7/2007 | Zhou |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,834,170 B2 | 11/2010 | Khvorova et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,178,503 B2 | 5/2012 | Rigoutsos et al. |
| 8,263,760 B2 | 9/2012 | De Kimpe et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,329,890 B2 | 12/2012 | Davidson et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,779,116 B2 | 7/2014 | Davidson et al. |
| 8,828,956 B2 | 9/2014 | Manoharan et al. |
| 8,901,095 B2 | 12/2014 | Corey et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 9,340,785 B2 | 5/2016 | Corey et al. |
| 9,487,779 B2 | 11/2016 | Davidson et al. |
| 9,574,191 B2 | 2/2017 | Corey et al. |
| 9,976,138 B2 | 5/2018 | Prakash et al. |
| 10,041,074 B2 | 8/2018 | Ozsolak |
| 10,364,432 B2 | 7/2019 | Van Roon-Mom et al. |

(56) References Cited

U.S. PATENT DOCUMENTS

| | | |
|---|---|---|
| 10,533,175 B2 | 1/2020 | Rigo et al. |
| 11,583,548 B2 | 2/2023 | Freier |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2005/0244851 A1 | 11/2005 | Blume et al. |
| 2005/0272080 A1 | 12/2005 | Palma et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |
| 2010/0190837 A1 | 7/2010 | Migawa et al. |
| 2010/0197762 A1 | 8/2010 | Swayze et al. |
| 2011/0190222 A1 | 8/2011 | Corey et al. |
| 2013/0130378 A1 | 5/2013 | Manoharan et al. |
| 2013/0198877 A1 | 8/2013 | Van Roon-Mom et al. |
| 2013/0225659 A1 | 8/2013 | Bennett |
| 2014/0039037 A1 | 2/2014 | Roon-Mom et al. |
| 2014/0107330 A1 | 4/2014 | Freier et al. |
| 2015/0018540 A1 | 1/2015 | Prakash et al. |
| 2015/0141320 A1 | 5/2015 | Krieg et al. |
| 2015/0184153 A1 | 7/2015 | Freier et al. |
| 2015/0191727 A1 | 7/2015 | Migawa et al. |
| 2015/0211006 A1* | 7/2015 | Butler ............... C12N 15/113 544/161 |
| 2015/0267195 A1 | 9/2015 | Seth et al. |
| 2015/0267197 A1 | 9/2015 | Bennett et al. |
| 2015/0275212 A1 | 10/2015 | Albaek et al. |
| 2015/0315595 A1 | 11/2015 | Uzcategui et al. |
| 2016/0159846 A1 | 6/2016 | Prakash et al. |
| 2018/0258425 A1 | 9/2018 | Rigo et al. |
| 2019/0247420 A1 | 8/2019 | Freier et al. |
| 2022/0064637 A1 | 3/2022 | Freier |

FOREIGN PATENT DOCUMENTS

| | | | |
|---|---|---|---|
| WO | WO 2004/013280 | 2/2004 | |
| WO | WO 2004/058940 | 7/2004 | |
| WO | WO 2006/006948 | 1/2006 | |
| WO | WO 2008/021149 | 2/2008 | |
| WO | WO 2010/014592 | 2/2010 | |
| WO | WO 2011/097388 | 8/2011 | |
| WO | WO 2011/097614 | 8/2011 | |
| WO | WO 2011/097643 | 8/2011 | |
| WO | WO 2012/012467 | 1/2012 | |
| WO | WO 2012/018257 | 2/2012 | |
| WO | WO 2013/033223 | 5/2013 | |
| WO | WO 2013/138353 | 9/2013 | |
| WO | WO 2013/173635 | 11/2013 | |
| WO | WO 2013/173637 | 11/2013 | |
| WO | WO 2015/017675 | 2/2015 | |
| WO | WO 2015/053624 | 4/2015 | |
| WO | WO 2015/089351 | 6/2015 | |
| WO | WO 2015/143246 | 9/2015 | |
| WO | WO 2017/053781 | 3/2017 | |
| WO | WO 2018/002886 | 1/2018 | |
| WO | WO-2018002886 A1 * | 1/2018 | ........... C12N 15/111 |
| WO | WO 2018/089805 | 5/2018 | |
| WO | WO 2019/217708 | 11/2019 | |
| WO | WO 2020/172559 | 8/2020 | |
| WO | WO 2020/245233 | 12/2020 | |

OTHER PUBLICATIONS

Alves et al., "Silencing ataxin-3 mitigates degeneration in a rat model of Machado-Joseph disease: no role for wild-type ataxin-3?" Hum. Mol. Gen. (2010) 19(12): 2380-2394.

Branch et al., "A good antisense molecule is hard to find," TIBS (1998) 23:45-50.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Costa et al., "Toward RNAi therapy for the polyglutamine disease Machado-Joseph disease" Mol Ther (2013) 21: 1898-1908.

Crooke et al., "Basic Principles of Antisense Therapeutics" Antisense Research and Application (1998) Chapter 1:1-50.

Crooke, St., et al., "Antisense Drug Technology" Second Edition, CRC Press (2008) Chapters 1-28.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Evers et al., "Ataxin-3 Protein and RNA Toxicity in Spinocerebellar Ataxia Type 3: Current Insights and Emerging Therapeutic Strategies." Mol Neurobiol (2014) 49:1513-1531.

Evers et al., "Ataxin-3 protein modification as a treatment strategy for spinocerebellar ataxia type 3: Removal of the CAG containing exon" Neurobiloby of Disease (2013) 58: 49-56.

Fiszer et al., "Oligonucleotide-based strategies to combat polyglutamine diseases" Nucleic Acids Res (2014) 42: 6787-6810.

Gautschi et al., "Activity of a novel bcl-2/bcl-xLbispecific antisense oligonucleotide against tumors of diverse histologic origins" J. Natl. Cancer Inst. (2001) 93:463-471.

GenBank Accession No. NM_004993.5 (downloaded Sep. 18, 2019).

Hu et al., "Allele-specific silencing of mutant huntingtin and ataxin-3 genes by targeting expanded CAG repeats in mRNAs." Nat. Biotech. (2009) 27(5): 478-484.

Hu et al., "Allele-selective inhibition of huntingtin expression by switching to an miRNA-like RNAi mechanism" Chem Biol (2010) 17(11): 1183-1188.

Hu et al., Allele-selective inhibition of ataxin-3 (ATX3) expression by antisense oligomers and duplex RNAs. Biol. Chem. (2011) 392(4): 315-325.

Kawaguchi et al., "CAG expansions in a novel gene for Machado-Joseph disease at chromosome 14q32.1." Nat. Genet. (1994) 8(3): 221-228.

Kenski et al., "siRNA-optimized Modifications for Enhanced In Vivo Activity" Mol Ther Nucleic Acids (2012) 1-8.

Liu et al., "ss-siRNAs allele selectively inhibit ataxin-3 expression: multiple mechanisms for an alternative gene silencing strategy." Nucleic Acids Res. (2013) 41(20): 9570-9583.

Maher et al., "Comparative hybrid arrest by tandem antisense oligodeoxyribonucleotides or oligodeoxyribonucleoside methylphosphonates in a cell-free system" Nucl. Acid. Res. (1988) 16(8):3341-3358.

McLoughlin et al., "Oligonucleotide therapy mitigates disease in Spinocerebellar Ataxia Type 3 mice." Annals of Neurology (2018) Accepted Article online Jun. 16, 2018, pp. 1-25.

Miller et al., "Allele-specific silencing of dominant disease genes." PNAS (2003) 100(12): 7195-7200.

Moore et al., "Evaluation of Antisense Oligonucleotides Targeting ATXN3 in SCA3 Mouse Models" Molecual Therapy: Nucliec Acids (2017) 7:200-210.

Moore et al., "Widespread In vivo suppression of mutant ATXN3 by antisense oligonucleotides in transgenic mouse models of SCA3" Society for Neuroscience 2016 Neuroscience meeting, San Diego, CA, Retreievd from the internet on Aug. 2, 2018, http://www.abstractsonline.com/pp8/#!/4071/presentation/6726.

Moore et al., "Widespread In vivo suppression of mutant ATXN3 by antisense oligonucleotides in transgenic mouse models of SCA3" Society for Neuroscience 2016 Neuroscience meeting, San Diego, CA, Poster Presentation Nov. 12, 2016.

New England Biolabs 1998/99 Catalog (cover page and pp. 121 and 284).

Reynolds et al., "Rational siRNA design for RNA interference" Nature Biotechnology (2004) 22(3):326-330.

Riess, et al., "SCA:3 Neurological features, patholgenesis and animal models." The Cerebellum (2008) 7:125-137.

Rodriguez-Lebron et al., "Silencing mutant ATXN3 expression resolves molecular phenotypes in SCA3 transgenic mice." Mol. Ther. (2013) 21(10): 1909-1918.

(56) References Cited

OTHER PUBLICATIONS

Sanghvi et al., "Heterocyclic Base Modifications in Nucleic Acids and Their Applications in Antisense Oligonucleotides" Antisense Research and Applications (1993) pp. 273-288.
Seidel et al., "Axonal inclusions in spinocerebellar ataxia type 3." Acta Neuropathol (2010) 120:449-460.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Toonen et al., "Antisense Oligonucleotide-Mediated Removal of the Polyglutamine Repeat in Spinocerebellar Ataxia Type 3 Mice" Mol Ther Nucleic Acids (2017) 8:232-242.
Toonen et al., "Ataxin-3 exon skipping as a treatment strategy for Spinocerebellar Ataxia type 3" Oligonucleotide Therapeutics Society 2015 Annual Meeting, Leiden, the Netherlands, Poster Presentaiton, Oct. 11, 2015.
Ward et al., "Ataxin-3, DAN damage repair, and SCA3 cerebellar degeneration: on the path to parsimony?" PLoS Genet (2015) 11(1):e1004937(1-4).
Woolf et al., "Specificity of antisense oligonucleotides in vivo" PNAS (1992) 89: 7305-7309.
Yu et al., "Single-stranded RNAs use RNAi to potently and allele-selectively inhibit mutant huntingtin expression" Cell (2012) 150(5): 895-908.
Partial Search Report for 16849742.8 dated Mar. 14, 2019.
Partial Search Report for 17869883.3 dated Apr. 24, 2020.
Extended EP Search report for 17869883.3 dated Jul. 16, 2020.
Extended EP Search report for 19799466.8 dated Jan. 14, 2022.
Extended EP Search Report for 20758529.0 dated Mar. 23, 2023.
International Search Report for PCT/US17/61121 dated Apr. 26, 2018.
International Search Report for PCT/US19/031562 dated Sep. 17, 2019.
International Search Report for PCT/US20/019272 dated Jul. 1, 2020.

* cited by examiner

COMPOUNDS AND METHODS FOR REDUCING ATXN3 EXPRESSION

SEQUENCE LISTING

The present application is being filed along with a Sequence Listing in electronic format. The Sequence Listing is provided as a file entitled BIOL0312SEQ.xml, created on Jan. 12, 2023, which is 3.22 MB in size. The information in the electronic format of the sequence listing is incorporated herein by reference in its entirety.

FIELD

Provided are compounds, methods, and pharmaceutical compositions for reducing the amount or activity of ATXN3 mRNA in a cell or animal, and in certain instances reducing the amount of Ataxin-3 protein in a cell or animal. Such compounds, methods, and pharmaceutical compositions are useful to prevent or ameliorate at least one symptom or hallmark of a neurodegenerative disease. Such symptoms and hallmarks include ataxia, neuropathy, and aggregate formation. Such neurodegenerative diseases include spinocerebellar ataxia type 3 (SCA3).

BACKGROUND

Spinocerebellar ataxia type 3 (SCA3), also known as Machado-Joseph disease (MJD), is caused by a mutation in the ATXN3 gene and is characterized by progressive cerebellar ataxia and variable findings including a dystonic-rigid syndrome, a parkinsonian syndrome, or a combined syndrome of dystonia and peripheral neuropathy. SCA3 is inherited in an autosomal dominant manner. Offspring of affected individuals have a 50% chance of inheriting the mutation. The diagnosis of SCA3 rests on the use of molecular genetic testing to detect an abnormal CAG trinucleotide repeat expansion in ATXN3. Affected individuals have alleles with 52 to 86 CAG trinucleotide repeats. Such testing detects 100% of affected individuals. Expanded CAG repeats in the ATXN3 gene are translated into expanded polyglutamine repeats (polyQ) in the ataxin-3 protein and this toxic ataxin-3 protein is associated with aggregates. The polyglutamine expanded ataxin-3 protein in these aggregates is ubiquinated and the aggregates contain other proteins, including heat shock proteins and transcription factors. Aggregates are frequently observed in the brain tissue of SCA3 patients. Management of SCA3 is supportive as no medication slows the course of disease; restless legs syndrome and extrapyramidal syndromes resembling parkinsonism may respond to levodopa or dopamine agonists; spasticity, drooling, and sleep problems respond variably to lioresal, atropine-like drugs, and hypnotic agents; botulinum toxin has been used for dystonia and spasticity; daytime fatigue may respond to psychostimulants such as modafinil; accompanying depression should be treated. Riess, O., Rüb, U., Pastore, A. et al. Cerebellum (2008) 7: 125.

Currently there is a lack of acceptable options for treating neurodegenerative diseases such as SCA3. It is therefore an object herein to provide compounds, methods, and pharmaceutical compositions for the treatment of such diseases.

SUMMARY OF THE INVENTION

Provided herein are compounds, methods, and pharmaceutical compositions for reducing the amount or activity of ATXN3 mRNA, and in certain embodiments reducing the amount of Ataxin-3 protein in a cell or animal. In certain embodiments, the animal has a neurodegenerative disease. In certain embodiments, the animal has SCA3. In certain embodiments, compounds useful for reducing expression of ATXN3 mRNA are oligomeric compounds or modified oligonucleotides. In certain embodiments, the oligomeric compound comprises a modified oligonucleotide.

Also provided are methods useful for ameliorating at least one symptom or hallmark of a neurodegenerative disease. In certain embodiments, the neurodegenerative disease is SCA3. In certain embodiments symptoms and hallmarks include ataxia, neuropathy, and aggregate formation. In certain embodiments, amelioration of these symptoms results in improved motor function, reduced neuropathy, and reduction in number of aggregates.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (uracil).

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "administering" means providing a pharmaceutical agent to an animal.

As used herein, "animal" means a human or non-human animal.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound or oligomeric duplex capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is ataxia, neuropathy, and aggregate formation. In certain embodiments, amelioration of these symptoms results in improved motor function, reduced neuropathy, or reduction in number of aggregates.

As used herein, "bicyclic nucleoside" or "BNA" means a nucleoside comprising a bicyclic sugar moiety. As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more sterorandom chiral centers. In certain embodiments, the molecules are modified oligonucleotides. In certain embodiments, the molecules are compounds comprising modified oligonucleotides.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly or indirectly attached to an oligonucleotide. Conjugate groups include a conjugate moiety and a conjugate linker that attaches the conjugate moiety to the oligonucleotide.

As used herein, "conjugate linker" means a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." Unless otherwise indicated, "gapmer" refers to a sugar motif. Unless otherwise indicated, the sugar moieties of the nucleosides of the gap of a gapmer are unmodified 2'-deoxyfuranosyl. Thus, the term "MOE gapmer" indicates a gapmer having a sugar motif of 2'-MOE nucleosides in both wings and a gap of 2'-deoxynucleosides. Unless otherwise indicated, a MOE gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid amenable to oligomeric compounds for reducing the amount or activity of the target nucleic acid as demonstrated in the examples hereinbelow.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, the term "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substitutent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligomeric compound are aligned.

As used herein, "MOE" means methoxyethyl. "2'-MOE" means a —OCH$_2$CH$_2$OCH$_3$ group at the 2' position of a furanosyl ring.

As used herein, "motif" means the pattern of unmodified and/or modified sugar moieties, nucleobases, and/or internucleoside linkages, in an oligonucleotide.

As used herein, "mRNA" means an RNA transcript that encodes a protein and includes pre-mRNA and mature mRNA unless otherwise specified.

As used herein, "neurodegenerative disease" means a condition marked by progressive loss of structure or function of neurons, including death of neurons. In certain embodiments, neurodegenerative disease is spinocerebellar ataxia type 3 (SCA3).

As used herein, "nucleobase" means an unmodified nucleobase or a modified nucleobase. As used herein an "unmodified nucleobase" is adenine (A), thymine (T), cytosine (C), uracil (U), and guanine (G).

As used herein, a "modified nucleobase" is a group of atoms other than unmodified A, T, C, U, or G capable of pairing with at least one unmodified nucleobase. A "5-methylcytosine" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiuous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water; sterile saline; or sterile buffer solution.

As used herein "pharmaceutically acceptable salts" means physiologically and pharmaceutically acceptable salts of compounds, such as oligomeric compounds, i.e., salts that retain the desired biological activity of the parent compound and do not impart undesired toxicological effects thereto.

As used herein "pharmaceutical composition" means a mixture of substances suitable for administering to a subject. For example, a pharmaceutical composition may comprise an antisense compound and a sterile aqueous solution. In certain embodiments, a pharmaceutical composition shows activity in free uptake assay in certain cell lines.

As used herein, "phosphorus moiety" means a group of atoms comprising a phosphorus atom. In certain embodiments, a phosphorus moiety comprises a mono-, di-, or tri-phosphate, or phosphorothioate.

As used herein "prodrug" means a therapeutic agent in a form outside the body that is converted to a different form within an animal or cells thereof. Typically conversion of a prodrug within the animal is facilitated by the action of an enzymes (e.g., endogenous or viral enzyme) or chemicals present in cells or tissues and/or by physiologic conditions.

As used herein, "reducing or inhibiting the amount or activity" refers to a reduction or blockade of the transcriptional expression or activity relative to the transcriptional expression or activity in an untreated or control sample and does not necessarily indicate a total elimination of transcriptional expression or activity.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "standard cell assay" means the assay described in Example 1 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) furanosyl moiety, as found in RNA (an "unmodified RNA sugar moiety"), or a 2'-H(H) moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate. As used herein, modified furanosyl sugar moiety means a furanosyl sugar comprising a non-hydrogen substituent in place of at least one hydrogen of an unmodified sugar moiety. In certain embodiments, a modified furanosyl sugar moiety is a 2'-substituted sugar moiety. Such modified furanosyl sugar moieties include bicyclic sugars and non-bicyclic sugars. As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or nucleic acids.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to an animal. For example, a therapeutically effective amount improves a symptom of a disease.

The present disclosure provides the following non-limiting numbered embodiments:

Embodiment 1. An oligomeric compound comprising a modified oligonucleotide consisting of 10-30 linked nucleosides and having a nucleobase sequence comprising at least 12, at least 13, at least 14, at least 15, or at least 16 contiguous nucleobases of any of SEQ ID NO: 23-334.

Embodiment 2. The oligomeric compound of embodiment 1, wherein the modified oligonucleotide has a nucleobase sequence that is at least 80%, 85%, 90%, 95%, or 100% complementary to the nucleobase sequence of SEQ ID NO: 1, when measured across the entire nucleobase sequence of the modified oligonucleotide.

Embodiment 3. The oligomeric compound of embodiments 1 or 2, wherein the modified oligonucleotide comprises at least one modified nucleoside.

Embodiment 4. The oligomeric compound of embodiments 3, wherein the modified oligonucleotide comprises at least one modified nucleoside comprising a modified sugar moiety.

Embodiment 5. The oligomeric compound of embodiment 4, wherein the modified oligonucleotide comprises at least one modified nucleoside comprising a bicyclic sugar moiety.

Embodiment 6. The oligomeric compound of embodiment 5, wherein the modified oligonucleotide comprises at least one modified nucleoside comprising a bicyclic sugar moiety having a 2'-4' bridge, wherein the 2'-4' bridge is selected from —O—CH$_2$—; and —O—CH(CH$_3$)—.

Embodiment 7. The oligomeric compound of any of embodiments 3-6, wherein the modified oligonucleotide comprises at least one modified nucleoside comprising a modified non-bicyclic sugar moiety.

Embodiment 8. The oligomeric compound of embodiment 7, wherein the modified oligonucleotide comprises at least one modified nucleoside comprising a non-bicyclic sugar moiety comprising a 2'-MOE or 2'-OMe.

Embodiment 9. The oligomeric compound of any of embodiments 4-8, wherein the modified oligonucleotide comprises at least one modified nucleoside comprising a sugar surrogate.

Embodiment 10. The oligomeric compound of embodiment 7, wherein the modified oligonucleotide comprises at least one modified nucleoside comprising a sugar surrogate selected from morpholino and PNA.

Embodiment 11. The oligomeric compound of any of embodiments 1-10, wherein the modified oligonucleotide has a sugar motif comprising:
a 5'-region consisting of 1-5 linked 5'-nucleosides; a central region consisting of 6-10 linked central region nucleosides; and a 3'-region consisting of 1-5 linked 3'-region nucleosides; wherein each of the 5'-region nucleosides and each of the 3'-region nucleosides comprises a modified sugar moiety and each of the central region nucleosides comprises an unmodified DNA sugar moiety.

Embodiment 12. The oligomeric compound of any of embodiments 1-11, wherein the modified oligonucleotide comprises at least one modified internucleoside linkage.

Embodiment 13. The oligomeric compound of embodiment 12, wherein each internucleoside linkage of the modified oligonucleotide is a modified internucleoside linkage.

Embodiment 14. The oligomeric compound of embodiment 12 or 13 wherein at least one internucleoside linkage is a phosphorothioate internucleoside linkage.

Embodiment 15. The oligomeric compound of embodiment 12 or 13 wherein the modified oligonucleotide comprises at least one phosphodiester internucleoside linkage.

Embodiment 16. The oligomeric compound of any of embodiments 12-15, wherein each internucleoside linkage is either a phosphodiester internucleoside linkage or a phosphorothioate internucleoside linkage.

Embodiment 17. The oligomeric compound of any of embodiments 1-16, wherein the modified oligonucleotide comprises at least one modified nucleobase.

Embodiment 18. The oligomeric compound of embodiment 17, wherein the modified nucleobase is a 5-methylcytosine.

Embodiment 19. The oligomeric compound of any of embodiments 1-18, wherein the modified oligonucleotide consists of 12-22, 12-20, 14-20, 16-20, or 18-20 linked nucleosides.

Embodiment 20. The oligomeric compound of any of embodiments 1-14, wherein the modified oligonucleotide consists of 16, 17, 18, 19 or 20 linked nucleosides.

Embodiment 21. The oligomeric compound of any of embodiments 1-20 consisting of the modified oligonucleotide.

Embodiment 22. The oligomeric compound of any of embodiments 1-20 comprising a conjugate group comprising a conjugate moiety and a conjugate linker.

Embodiment 23. The oligomeric compound of embodiment 22, wherein the conjugate group comprises a GalNAc cluster comprising 1-3 GalNAc ligands.

Embodiment 24. The oligomeric compound of embodiment 22 or 23, wherein the conjugate linker consists of a single bond.

Embodiment 25. The oligomeric compound of embodiment 23, wherein the conjugate linker is cleavable.

Embodiment 26. The oligomeric compound of embodiment 25, wherein the conjugate linker comprises 1-3 linker-nucleosides.

Embodiment 27. The oligomeric compound of any of embodiments 22-26, wherein the conjugate group is attached to the modified oligonucleotide at the 5'-end of the modified oligonucleotide.

Embodiment 28. The oligomeric compound of any of embodiments 22-26, wherein the conjugate group is attached to the modified oligonucleotide at the 3'-end of the modified oligonucleotide.

Embodiment 29. The oligomeric compound of any of embodiments 1-28 comprising a terminal group.

Embodiment 30. The oligomeric compound of any of embodiments 1-29 wherein the oligomeric compound is a singled-stranded oligomeric compound.

Embodiment 31. The oligomeric compound of any of embodiments 1-25 or 27-30, wherein the oligomeric compound does not comprise linker-nucleosides.

Embodiment 32. An oligomeric duplex comprising an oligomeric compound of any of embodiments 1-29 and 31.

Embodiment 33. An antisense compound comprising or consisting of an oligomeric compound of any of embodiments 1-31 or an oligomeric duplex of embodiment 32.

Embodiment 34. A modified oligonucleotide consisting of 10-30 linked nucleosides and having a nucleobase sequence comprising at least 12, at least 13, at least 14, at least 15, or at least 16 contiguous nucleobases of any of SEQ ID NO: 23-334.

Embodiment 35. An oligomeric compound comprising a modified oligonucleotide consisting of 10-30 linked nucleosides and having a nucleobase sequence comprising a portion of at least 8, at least 9, at least 10, at least 11, at least 12, at least 13, or at least 14 contiguous nucleobases 100% complementary to an equal length portion of nucleobases 614-637 of SEQ ID NO: 1, nucleobases 833-852 of SEQ ID NO: 1, or nucleobases 1091-1131 of SEQ ID NO: 1, wherein the nucleobase sequence of the modified oligonucleotide is at least 90% complementary to SEQ ID NO: 1 as measured over the entirety of the modified oligonucleotide.

Embodiment 36. A pharmaceutical composition comprising an oligomeric compound of any of embodiments 1-31 and 35, an oligomeric duplex of embodiment 32, or a modified oligonucleotide of embodiment 34 and a pharmaceutically acceptable carrier or diluent.

Embodiment 37. A method comprising administering to an animal a pharmaceutical composition of embodiments 36.

Embodiment 38. A method of treating a disease associated with ATXN3 comprising administering to an individual having or at risk for developing a disease associated with ATXN3 a therapeutically effective amount of a pharmaceutical composition according to embodiment 36; and thereby treating the disease associated with ATXN3.

Embodiment 39. The method of embodiment 38, wherein the disease associated with ATXN3 is a neurodegenerative disease.

Embodiment 40. The method of embodiment 39, wherein the neurodegenerative disease is SCA3.

Embodiment 41. The method of embodiment 39, wherein at least one symptom or hallmark of the neurodegenerative disease is ameliorated.

Embodiment 42. The method of embodiment 41, wherein the symptom or hallmark is ataxia, neuropathy, and aggregate formation.

Embodiment 43. A chirally enriched population of oligomeric compounds of any of embodiments 1-32 or 35 wherein the population is enriched for modified oligonucleotides comprising at least one particular phosphorothioate internucleoside linkage having a particular stereochemical configuration.

Embodiment 44. The chirally enriched population of embodiment 43, wherein the population is enriched for modified oligonucleotides comprising at least one particular phosphorothioate internucleoside linkage having the (Sp) configuration.

Embodiment 45. The chirally enriched population of embodiment 43, wherein the population is enriched for modified oligonucleotides comprising at least one particular phosphorothioate internucleoside linkage having the (Rp) configuration.

Embodiment 46. The chirally enriched population of embodiment 43, wherein the population is enriched for modified oligonucleotides having a particular, independently selected stereochemical configuration at each phosphorothioate internucleoside linkage Embodiment 47. The chirally enriched population of embodiment 46, wherein the population is enriched for modified oligonucleotides having the (Sp) configuration at each phosphorothioate internucleoside linkage.

Embodiment 48. The chirally enriched population of embodiment 46, wherein the population is enriched for modified oligonucleotides having the (Rp) configuration at each phosphorothioate internucleoside linkage.

Embodiment 49. The chirally enriched population of embodiment 46, wherein the population is enriched for modified oligonucleotides having the (Rp) configuration at one particular phosphorothioate internucleoside linkage and the (Sp) configuration at each of the remaining phosphorothioate internucleoside linkages.

Embodiment 50. The chirally enriched population of embodiment 43 or embodiment 46 wherein the population is enriched for modified oligonucleotides having at least 3 contiguous phosphorothioate internucleoside linkages in the Sp, Sp, and Rp configurations, in the 5' to 3' direction.

Embodiment 51. A chirally enriched population of oligomeric compounds of any of embodiments 1-32 or 35, wherein all of the phosphorothioate internucleoside linkages of the modified oligonucleotide are stereorandom.

Embodiment 52. A chirally enriched population of modified oligonucleotides of embodiment 34 wherein the population is enriched for modified oligonucleotides comprising at least one particular phosphorothioate internucleoside linkage having a particular stereochemical configuration.

Embodiment 53. The chirally enriched population of embodiment 52, wherein the population is enriched for modified oligonucleotides comprising at least one particular phosphorothioate internucleoside linkage having the (Sp) configuration.

Embodiment 54. The chirally enriched population of embodiment 52, wherein the population is enriched for modified oligonucleotides comprising at least one particular phosphorothioate internucleoside linkage having the (Rp) configuration.

Embodiment 55. The chirally enriched population of embodiment 52, wherein the population is enriched for modified oligonucleotides having a particular, independently selected stereochemical configuration at each phosphorothioate internucleoside linkage Embodiment 56. The chirally enriched population of embodiment 55, wherein the population is enriched for modified oligonucleotides having the (Sp) configuration at each phosphorothioate internucleoside linkage.

Embodiment 57. The chirally enriched population of embodiment 55, wherein the population is enriched for modified oligonucleotides having the (Rp) configuration at each phosphorothioate internucleoside linkage.

Embodiment 58. The chirally enriched population of embodiment 55, wherein the population is enriched for modified oligonucleotides having the (Rp) configuration at one particular phosphorothioate internucleoside linkage and the (Sp) configuration at each of the remaining phosphorothioate internucleoside linkages.

Embodiment 59. The chirally enriched population of embodiment 52 or embodiment 55 wherein the population is enriched for modified oligonucleotides having at least 3 contiguous phosphorothioate internucleoside linkages in the Sp, Sp, and Rp configurations, in the 5' to 3' direction.

Embodiment 60. A chirally enriched population of modified oligonucleotides of embodiment 34, wherein all of the phosphorothioate internucleoside linkages of the modified oligonucleotide are stereorandom.

I. Certain Oligonucleotides

In certain embodiments, provided herein are oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-OCH$_3$ ("OMe" or "O-methyl"), and 2'-O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkynyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836).

In certain embodiments, a 2'-substituted non-bicyclic modified nucleoside comprises a sugar moiety comprising a non-bridging 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O(CH$_2$)$_2$ON(R$_m$)(R$_n$), O(CH$_2$)$_2$O(CH$_2$)$_2$N(CH$_3$)$_2$, and N-substituted acetamide (OCH$_2$C(=O)—N(R$_m$)(R$_n$)), where each R$_m$ and R$_n$ is, independently, H, an amino protecting group, or substituted or unsubstituted C$_1$-C$_{10}$ alkyl.

In certain embodiments, a 2'-substituted nucleoside non-bicyclic modified nucleoside comprises a sugar moiety comprising a non-bridging 2'-substituent group selected from: F, OCF$_3$, OCH$_3$, OCH$_2$CH$_2$OCH$_3$, O(CH$_2$)$_2$SCH$_3$, O(CH$_2$)$_2$ON(CH$_3$)$_2$, O(CH$_2$)$_2$O(CH$_2$)$_2$N(CH$_3$)$_2$, and OCH$_2$C(=O)—N(H)CH$_3$ ("NMA").

In certain embodiments, a 2'-substituted non-bicyclic modified nucleoside comprises a sugar moiety comprising a non-bridging 2'-substituent group selected from: F, OCH$_3$, and OCH$_2$CH$_2$OCH$_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-CH$_2$-2', 4'-(CH$_2$)$_2$-2', 4'-(CH$_2$)$_3$-2', 4'-CH$_2$—O-2' ("LNA"), 4'-CH$_2$—S-2', 4'-(CH$_2$)$_2$—O-2' ("ENA"), 4'-CH(CH$_3$)—O-2' (referred to as "constrained ethyl" or "cEt"), O—CH$_2$-2', 4'-CH$_2$—N(R)-2', 4'-CH(CH$_2$OCH$_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-C(CH$_3$)(CH$_3$)—O-2' and analogs thereof (see, e.g., Seth et al., U.S. Pat. No. 8,278,283), 4'-CH$_2$—N(OCH$_3$)-2' and analogs thereof (see, e.g., Prakash et al., U.S. Pat. No. 8,278,425), 4'-CH$_2$—O—N(CH$_3$)-2' (see, e.g., Allerson et al., U.S. Pat. No. 7,696,345 and Allerson et al., U.S. Pat. No. 8,124,745), 4'-CH$_2$—C(H)(CH$_3$)-2' (see, e.g., Zhou, et al., J. Org. Chem., 2009, 74, 118-134), 4'-CH$_2$—C(=CH$_2$)-2' and analogs thereof (see e.g., Seth et al., U.S. Pat. No. 8,278, 426), 4'-C(R$_a$R$_b$)—N(R)—O-2', 4'-C(R$_a$R$_b$)—O—N(R)-2', 4'-CH$_2$—O—N(R)-2', and 4'-CH$_2$—N(R)—O- 2', wherein each R, R$_a$, and R$_b$ is, independently, H, a protecting group, or C$_1$-C$_{12}$ alkyl (see, e.g. Imanishi et al., U.S. Pat. No. 7,427,672).

In certain embodiments, such 4' to 2' bridges independently comprise from 1 to 4 linked groups independently selected from: —[C(R$_a$)(R$_b$)]$_n$—, [C(R$_a$)(R$_b$)]$_n$—O—, —C(R$_a$)=C(R$_b$)—, —C(R$_a$)=N—, —C(=NR$_a$)—, —C(=O)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 20017, 129, 8362-8379; Wengel et al., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. 7,547,684; Seth et al., U.S. Pat. No. 7,666,854; Seth et al., U.S. Pat. No. 8,088,746; Seth et al., U.S. Pat. No. 7,750,131; Seth et al., U.S. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

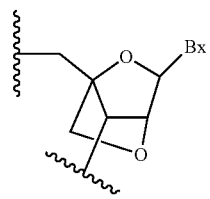
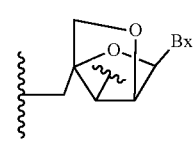

LNA (β-D-configuration)
bridge =
4'-CH$_2$—O-2'

α-L-LNA (α-L-configuration)
bridge =
4'-CH$_2$—O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

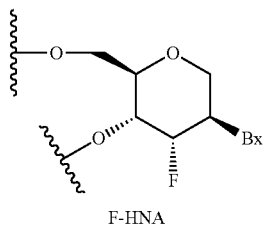

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

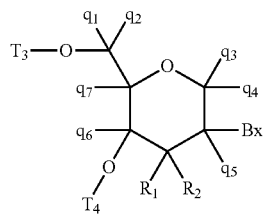

wherein, independently, for each of said modified THP nucleoside:

Bx is a nucleobase moiety;

T$_3$ and T$_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

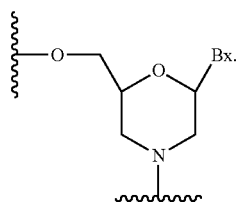

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides).

2. Certain Modified Nucleobases

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl ($-C\equiv C-CH_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859; Englisch et at, Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases as well as other modified nucleobases include without limitation, Manohara et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—CH$_2$—N(CH$_3$)—O—CH$_2$—), thiodiester, thionocarbamate (—O—C(=O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

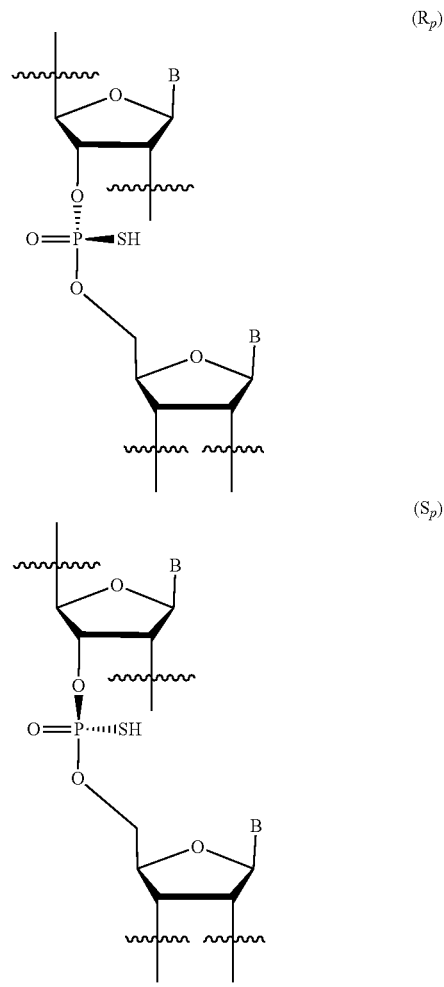

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-CH$_2$—N(CH$_3$)—O-5'), amide-3 (3'-CH$_2$—C(=O)—N(H)-5'), amide-4 (3'-CH$_2$—N(H)—C(=O)-5'), formacetal (3'-O—CH$_2$—O-5'), methoxypropyl, and thioformacetal (3'-S—CH$_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, each nucleoside of each wing of a gapmer is a modified nucleoside.

In certain embodiments, the gap of a gapmer comprises 7-12 nucleosides. In certain embodiments, each nucleoside of the gap of a gapmer is an unmodified 2'-deoxy nucleoside.

In certain embodiments, the gapmer is a deoxy gapmer. In embodiments, the nucleosides on the gap side of each wing/gap junction are unmodified 2'-deoxy nucleosides and the nucleosides on the wing sides of each wing/gap junction are modified nucleosides. In certain embodiments, each nucleoside of the gap is an unmodified 2'-deoxy nucleoside. In certain embodiments, each nucleoside of each wing of a gapmer is a modified nucleoside.

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]-[# of nucleosides in the gap]-[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in the wings and the gap nucleosides comprise unmodified deoxynucleosides sugars. Thus, a 5-10-5 MOE gapmer consists of 5 linked MOE modified nucleosides in the 5'-wing, 10 linked deoxynucleosides in the gap, and 5 linked MOE nucleosides in the 3'-wing.

In certain embodiments, modified oligonucleotides are 5-10-5 MOE gapmers. In certain embodiments, modified oligonucleotides are 3-10-3 BNA gapmers. In certain embodiments, modified oligonucleotides are 3-10-3 cEt gapmers. In certain embodiments, modified oligonucleotides are 3-10-3 LNA gapmers.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines. In certain embodiments, all of the cytosine nucleobases are 5-methylcytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate, a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target mRNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides D. Certain Modified Oligonucleotides In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular sterochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 15%, or 100% complementary to the second oligonucleotide or nucleic acid, such as a target nucleic acid.

II. Certain Oligomeric Compounds

In certain embodiments, the invention provides oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N.Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO* 1, 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic acid a palmityl moiety (Mishra et al., Biochim. Biophys. Acta, 1995, 1264, 229-237), an octadecylamine or hexylamino-carbonyl-oxycholesterol moiety (Crooke et al., *J. Pharmacol. Exp. Ther.*, 1996, 277, 923-937), a tocopherol group (Nishina et al., *Molecular Therapy Nucleic Acids*, 2015, 4, e220; and Nishina et al., *Molecular Therapy*, 2008, 16, 734-740), or a GalNAc cluster (e.g., WO2014/179620).

1. Conjugage Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugage Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl)cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodimements, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

B. Certain Terminal Groups

In certain embodiments, oligomeric compounds comprise one or more terminal groups. In certain such embodiments, oligomeric compounds comprise a stabilized 5'-phophate. Stabilized 5'-phosphates include, but are not limited to 5'-phosphanates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a region complementary to a target nucleic acid and a second oligomeric compound having a region complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not byridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

V. Certain Target Nucleic Acids

In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and a 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligomeric compounds comprise oligonucletoides that are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligomeric compound comprising an oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. ATXN3

In certain embodiments, oligomeric compounds comprise or consist of an oligonucleotide comprising a region that is complementary to a target nucleic acid, wherein the target nucleic acid is ATXN3. In certain embodiments, ATXN3 nucleic acid has the sequence set forth in SEQ ID NO: 1 (GENBANK Accession No: NM_004993.5); SEQ ID NO: 2 (GENBANK Accession No: GENBANK Accession No. NT_026437.12 truncated from nucleotides 73,524,000 to 73,574,000); SEQ ID NO: 3 (GENBANK Accession No: NM_001164778.1); SEQ ID NO: 4 (GENBANK Accession No: NM_001127696.1); SEQ ID NO: 5 (GENBANK Accession No: NM_001164781.1); SEQ ID NO: 6 (GENBANK Accession No: NR_028454.1); SEQ ID NO: 7 (GENBANK Accession No: NM_001164780.1); SEQ ID NO: 8 (GENBANK Accession No: NR_028469.1); SEQ ID NO: 9 (GENBANK Accession No: NM_001164779.1); SEQ ID NO: 10 (GENBANK Accession No: NR 028461.1); SEQ ID NO: 11 (GENBANK Accession No: NR_028466.1); SEQ ID NO: 12 (GENBANK Accession No: NR_028462.1); SEQ ID NO: 13 (GENBANK Accession No: NR_028467.1); SEQ ID NO: 14 (GENBANK Accession No: NR_031765.1); SEQ ID NO: 15 (GENBANK Accession No: NM_001164782.1): SEQ ID NO: 16 (GENBANK Accession No: NR_028465.1); SEQ ID NO: 17 (GENBANK Accession No: NR_028457.1); SEQ ID NO: 18 (GENBANK Accession No: NM_001164777.1); and SEQ ID NO: 19 (GENBANK Accession No: NM_001164774.1).

In certain embodiments, contacting a cell with an oligomeric compound complementary to SEQ ID NO: 1-19 reduces the amount of ATXN3 mRNA, and in certain embodiments reduces the amount of Ataxin-3 protein. In certain embodiments, contacting a cell in an animal with an oligomeric compound complementary to SEQ ID NO: 1-19 ameliorate one or more symptoms or hallmarks of neurodegenerative disease. In certain embodiments, such symptoms and hallmarks include ataxia, neuropathy, and aggregate formation. In certain embodiments, the neurodegenerative disease is spinocerebellar ataxia type 3 (SCA3).

VI. Certain Hotspot Regions

1. Nucleobases 614-637 of SEQ ID NO: 1

In certain embodiments, modified oligonucleotides are complementary to nucleobases 614-637 of SEQ ID NO: 1. In certain embodiments, nucleobases 614-637 of SEQ ID NO: 1 is a hotspot region. In certain embodiments, such modified oligonucleotides are 18 nucleobases in length. In certain embodiments, such modified oligonucleotides are gapmers. In certain such embodiments, the gapmers are 5-8-5 MOE gapmers. In certain embodiments, the nucleosides of the modified oligonucleotides are linked by mixed phosphodiester ("o") and phosphorothioate ("s") internucleoside linkages. In certain embodiments, the mixed phosphodiester ("o") and phosphorothioate ("s") internucleoside linkages arranged in order from 5' to 3': sooossssssssssooss.

The nucleobase sequences of SEQ ID Nos: 73, 74, and 75 are complementary to nucleobases 614-637 of SEQ ID NO: 1.

In certain embodiments, modified oligonucleotides complementary to nucleobases 614-637 of SEQ ID NO: 1 achieve at least 40% reduction of ATXN3 mRNA in vitro in the standard cell assay.

2. Nucleobases 833-852 of SEQ ID NO: 1

In certain embodiments, modified oligonucleotides are complementary to nucleobases 833-852 of SEQ ID NO: 1. In certain embodiments, nucleobases 833-852 of SEQ ID NO: 1 is a hotspot region. In certain embodiments, such modified oligonucleotides are 18 nucleobases in length. In certain embodiments, such modified oligonucleotides are gapmers. In certain such embodiments, the gapmers are 5-8-5 MOE gapmers. In certain embodiments, the nucleosides of the modified oligonucleotides are linked by mixed phosphodiester ("o") and phosphorothioate ("s") internucleoside linkages. In certain embodiments, the mixed phosphodiester ("o") and phosphorothioate ("s") internucleoside linkages arranged in order from 5' to 3': sooosssssssssssooss.

The nucleobase sequences of SEQ ID Nos: 86 and 87 are complementary to nucleobases 833-852 of SEQ ID NO: 1.

In certain embodiments, modified oligonucleotides complementary to nucleobases 833-852 of SEQ ID NO: 1 achieve at least 30% reduction of ATXN3 mRNA in vitro in the standard cell assay.

3. Nucleobases 1091-1131 of SEQ ID NO: 1

In certain embodiments, modified oligonucleotides are complementary to nucleobases 1091-1131 of SEQ ID NO: 1. In certain embodiments, nucleobases 1091-1131 of SEQ ID NO: 1 is a hotspot region. In certain embodiments, such modified oligonucleotides are 18 nucleobases in length. In certain embodiments, such modified oligonucleotides are gapmers. In certain such embodiments, the gapmers are 5-8-5 MOE gapmers. In certain embodiments, the nucleosides of the modified oligonucleotides are linked by mixed phosphodiester ("o") and phosphorothioate ("s") internucleoside linkages. In certain embodiments, the mixed phosphodiester ("o") and phosphorothioate ("s") internucleoside linkages arranged in order from 5' to 3': sooosssssssssssooss.

The nucleobase sequences of SEQ ID Nos: 98, 99, 100, 101, and 102 are complementary to nucleobases 1091-1131 of SEQ ID NO: 1.

In certain embodiments, modified oligonucleotides complementary to nucleobases 1091-1131 of SEQ ID NO: 1 achieve at least 30% reduction of ATXN3 mRNA in vitro in the standard cell assay.

C. Certain Target Nucleic Acids in Certain Tissues

In certain embodiments, oligomeric compounds comprise or consist of an oligonucleotide comprising a region that is complementary to a target nucleic acid, wherein the target nucleic acid is expressed in a pharmacologically relevant tissue.

VII. Certain Pharmaceutical Compositions

In certain embodiments, described herein are pharmaceutical compositions comprising one or more oligomeric compounds or a salt thereof. In certain embodiments, the pharmaceutical composition comprises a pharmaceutically acceptable diluent or carrier. In certain embodiments, a pharmaceutical composition comprises a sterile saline solution and one or more oligomeric compound. In certain embodiments, a pharmaceutical composition consists of a sterile saline solution and one or more oligomeric compound. In certain embodiments, the sterile saline is pharmaceutical grade saline. In certain embodiments, a pharmaceutical composition comprises one or more oligomeric compound and sterile water. In certain embodiments, a pharmaceutical composition consists of one oligomeric compound and sterile water. In certain embodiments, the sterile water is pharmaceutical grade water. In certain embodiments, a pharmaceutical composition comprises one or more oligomeric compound and phosphate-buffered saline (PBS). In certain embodiments, a pharmaceutical composition consists of one or more oligomeric compound and sterile PBS. In certain embodiments, the sterile PBS is pharmaceutical grade PBS.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal, intracerebroventricular, etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes. Aqueous injection suspensions may contain.

Nonlimiting Disclosure and Incorporation by Reference

Each of the literature and patent publications listed herein is incorporated by reference in its entirety. While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "ATmCGAUCG," wherein $^m$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, all tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of Modified Oligonucleotides on Human ATXN3 In Vitro, Single Dose Modified oligonucleotides complementary to an ATXN3 nucleic acid were designed and tested for their effect on ATXN3 mRNA in vitro. The modified oligonucleotides were tested in a series of experiments that had similar culture conditions.

Cultured HepG2 cells at a density of 20,000 cells per well were transfected using electroporation with a 2,000 nM concentration of modified oligonucleotide. After a treatment period of approximately 24 hours, RNA was isolated from the cells and ATXN3 mRNA levels were measured by quantitative real-time PCR. Human primer probe set RTS4392 (forward primer sequence TCAGGACAGAGTT-CACATCCATGT, designated herein as SEQ ID NO: 20; reverse primer sequence TTCACTCATAGCATCACCTA-GATCACT, designated herein as SEQ ID NO: 21; probe sequence AAGGCCAGCCACCAGTTCAGGAGC, designated herein as SEQ ID NO: 22) was used to measure mRNA levels. ATXN3 mRNA levels were adjusted according to total RNA content, as measured by RIBOGREEN®. Results are presented as percent reduction of the amount of ATXN3 mRNA, relative to untreated control cells (these conditions describe a "standard cell assay"). The oligonucleotides marked with an asterisk (*) target the amplicon region of the primer probe set. Additional assays may be used to measure the potency and efficacy of these oligonucleotides.

The modified oligonucleotides in the table below were designed as 5-8-5 MOE gapmers. The gapmers are 18 nucleosides in length, wherein the central gap segment comprises eight 2'-deoxynucleosides and is flanked by wing segments on both the 5' end and on the 3' end comprising five nucleosides each. Each nucleoside in the 5' wing segment and each nucleoside in the 3' wing segment comprises a MOE modification. All cytosine residues throughout each gapmer are 5-methylcytosines. The internucleoside linkages are mixed phosphodiester and phosphorothioate linkages. The internucleoside linkages are arranged in order from 5' to 3': sooosssssssssooss; wherein ("o") is phosphodiester and ("s") is phosphorothioate. "Start site" indicates the 5'-most nucleoside to which the gapmer is targeted in the human gene sequence. "Stop site" indicates the 3'-most nucleoside to which the gapmer is targeted human gene sequence.

Each modified oligonucleotide listed in Table 1 is targeted to either human ATXN3 mRNA sequence (isoform 1), designated herein as SEQ ID NO: 1 (GENBANK Accession No. NM_004993.5) or the human ATXN3 genomic sequence, designated herein as SEQ ID NO: 2 (GENBANK Accession No. NT_026437.12 truncated from nucleotides 73,524,000 to 73,574,000), or both. 'N/A' indicates that the antisense oligonucleotide does not target that particular gene sequence with 100% complementarity.

TABLE 1

Percent reduction of human ATXN3 mRNA by modified oligonucleotides relative to control

| IONIS No | SEQ ID No: 1 Start Site | SEQ ID No: 1 Stop Site | SEQ ID No: 2 Start Site | SEQ ID No: 2 Stop Site | Sequence (5' to 3') | % In-hib. | SEQ ID No |
|---|---|---|---|---|---|---|---|
| 650362 | 14 | 31 | 1049 | 1066 | $A_{es}{}^mC_{eo}{}^mC_{eo}{}^mC_{eo}{}^mC_{es}{}^mC_{ds}T_{ds}{}^mC_{ds}{}^mC_{ds}A_{ds}G_{ds}{}^mC_{ds}T_{ds}{}^mC_{eo}{}^mC_{eo}G_{es}{}^mC_{es}{}^mC_e$ | 0 | 23 |
| 650363 | 37 | 54 | 1072 | 1089 | $G_{es}{}^mC_{eo}{}^mC_{eo}A_{eo}A_{es}{}^mC_{ds}G_{ds}G_{ds}{}^mC_{ds}{}^mC_{ds}{}^mC_{ds}{}^mC_{ds}{}^mC_{ds}A_{eo}{}^mC_{eo}G_{es}{}^mC_{es}{}^mC_e$ | 10 | 24 |
| 650364 | 43 | 60 | 1078 | 1095 | $T_{es}{}^mC_{eo}T_{eo}G_{eo}G_{es}A_{ds}G_{ds}{}^mC_{ds}{}^mC_{ds}A_{ds}A_{ds}{}^mC_{ds}G_{ds}G_{eo}{}^mC_{eo}{}^mC_{es}{}^mC_{es}{}^mC_e$ | 0 | 25 |
| 650365 | 48 | 65 | 1083 | 1100 | $A_{es}T_{eo}T_{eo}T_{eo}G_{es}T_{ds}{}^mC_{ds}T_{ds}G_{ds}G_{ds}A_{ds}G_{ds}{}^mC_{ds}{}^mC_{eo}A_{eo}A_{es}{}^mC_{es}G_e$ | 2 | 26 |
| 650366 | 53 | 70 | 1088 | 1105 | $T_{es}G_{eo}T_{eo}T_{eo}T_{es}A_{ds}T_{ds}T_{ds}T_{ds}G_{ds}T_{ds}{}^mC_{ds}T_{ds}G_{eo}G_{eo}A_{es}G_{es}{}^mC_e$ | 25 | 27 |
| 650367 | 59 | 76 | 1094 | 1111 | $A_{es}{}^mC_{eo}T_{eo}{}^mC_{eo}{}^mC_{es}A_{ds}T_{ds}G_{ds}T_{ds}T_{ds}A_{ds}T_{ds}T_{eo}T_{eo}G_{es}T_{es}{}^mC_e$ | 8 | 28 |
| 650368 | 64 | 81 | 1099 | 1116 | $G_{es}A_{eo}T_{eo}G_{eo}G_{es}A_{ds}{}^mC_{ds}T_{ds}{}^mC_{ds}{}^mC_{ds}A_{ds}T_{ds}G_{ds}T_{eo}T_{eo}T_{es}A_{es}T_e$ | 0 | 29 |
| 650369 | 69 | 86 | 1104 | 1121 | $T_{es}G_{eo}G_{eo}A_{eo}A_{es}G_{ds}A_{ds}T_{ds}G_{ds}G_{ds}A_{ds}{}^mC_{ds}T_{ds}{}^mC_{eo}{}^mC_{eo}A_{es}T_{es}G_e$ | 13 | 30 |
| 650370 | 87 | 104 | N/A | N/A | $G_{es}A_{eo}G_{eo}{}^mC_{eo}{}^mC_{es}T_{ds}T_{ds}{}^mC_{ds}T_{ds}T_{ds}G_{ds}T_{ds}T_{ds}T_{eo}{}^mC_{eo}T_{es}{}^mC_{es}G_e$ | 33 | 31 |
| 650371 | 92 | 109 | N/A | N/A | $A_{es}A_{eo}A_{eo}G_{eo}T_{es}G_{ds}A_{ds}G_{ds}{}^mC_{ds}{}^mC_{ds}T_{ds}T_{ds}{}^mC_{ds}T_{eo}T_{eo}G_{es}T_{es}T_e$ | 20 | 32 |
| 650372 | 97 | 114 | 10822 | 10839 | $A_{es}G_{eo}{}^mC_{eo}A_{eo}{}^mC_{es}A_{ds}A_{ds}A_{ds}G_{ds}T_{ds}G_{ds}A_{ds}G_{ds}{}^mC_{eo}{}^mC_{eo}T_{es}T_{es}{}^mC_e$ | 57 | 33 |
| 650373 | 100 | 117 | 10825 | 10842 | $T_{es}T_{eo}G_{eo}A_{eo}G_{es}{}^mC_{ds}A_{ds}{}^mC_{ds}A_{ds}A_{ds}A_{ds}G_{ds}T_{ds}G_{eo}A_{eo}G_{es}{}^mC_{es}{}^mC_e$ | 19 | 34 |

TABLE 1-continued

Percent reduction of human ATXN3 mRNA by modified oligonucleotides relative to control

| IONIS No | SEQ ID No: 1 Start Site | SEQ ID No: 1 Stop Site | SEQ ID No: 2 Start Site | SEQ ID No: 2 Stop Site | Sequence (5' to 3') | % Inhib. | SEQ ID No |
|---|---|---|---|---|---|---|---|
| 650374 | 123 | 140 | 10848 | 10865 | $T_{es}G_{eo}{}^mC_{eo}A_{eo}A_{es}T_{ds}A_{ds}A_{ds}G_{ds}T_{ds}T_{ds}A_{ds}T_{ds}T_{eo}{}^mC_{eo}A_{es}G_{es}G_e$ | 39 | 35 |
| 650375 | 147 | 164 | 10872 | 10889 | $T_{es}{}^mC_{eo}{}^mC_{eo}A_{eo}{}^mC_{es}A_{ds}G_{ds}G_{ds}G_{ds}{}^mC_{ds}T_{ds}A_{ds}A_{ds}A_{eo}T_{es}A_{es}T_e$ | 0 | 36 |
| 650376 | 170 | 187 | 10895 | 10912 | $G_{es}{}^mC_{eo}T_{eo}G_{eo}A_{es}T_{ds}G_{ds}T_{ds}G_{ds}{}^mC_{ds}A_{ds}A_{ds}T_{eo}G_{eo}A_{es}G_{es}G_e$ | 36 | 37 |
| 650377 | 195 | 212 | 10920 | 10937 | $A_{es}T_{eo}T_{eo}{}^mC_{eo}T_{es}{}^mC_{ds}A_{ds}T_{ds}{}^mC_{ds}{}^mC_{ds}T_{ds}{}^mC_{ds}T_{ds}{}^mC_{eo}{}^mC_{eo}T_{es}{}^mC_{es}{}^mC_e$ | 29 | 38 |
| 650378 | 218 | 235 | 10943 | 10960 | ${}^mC_{es}A_{eo}{}^mC_{eo}T_{eo}A_{es}G_{ds}T_{ds}A_{ds}A_{ds}{}^mC_{ds}T_{ds}{}^mC_{ds}{}^mC_{ds}T_{eo}{}^mC_{eo}C_{es}T_{es}T_e$ | 39 | 39 |
| 650379 | 248 | 265 | N/A | N/A | $A_{es}A_{eo}G_{eo}G_{eo}{}^mC_{es}T_{ds}G_{ds}{}^mC_{ds}T_{ds}G_{ds}T_{ds}A_{ds}A_{ds}A_{eo}A_{eo}{}^mC_{es}G_e$ | 55 | 40 |
| 650380 | 251 | 268 | N/A | N/A | ${}^mC_{es}A_{eo}G_{eo}A_{eo}A_{es}G_{ds}G_{ds}{}^mC_{ds}T_{ds}G_{ds}{}^mC_{ds}T_{ds}G_{ds}T_{eo}A_{eo}A_{es}A_{es}A_e$ | 17 | 41 |
| 650381 | 256 | 273 | 11517 | 11534 | $A_{es}T_{eo}T_{eo}T_{eo}{}^mC_{es}{}^mC_{ds}A_{ds}G_{ds}A_{ds}A_{ds}A_{ds}G_{ds}G_{ds}{}^mC_{ds}T_{eo}G_{eo}{}^mC_{es}T_{es}G_e$ | 21 | 42 |
| 650382 | 261 | 278 | 11522 | 11539 | $T_{es}{}^mC_{eo}{}^mC_{eo}A_{eo}T_{es}A_{ds}T_{ds}T_{ds}T_{ds}{}^mC_{ds}{}^mC_{ds}A_{ds}G_{ds}A_{eo}A_{eo}G_{es}G_{es}{}^mC_e$ | 43 | 43 |
| 650383 | 266 | 283 | 11527 | 11544 | $T_{es}G_{eo}T_{eo}{}^mC_{eo}A_{es}T_{ds}{}^mC_{ds}{}^mC_{ds}A_{ds}T_{ds}A_{ds}T_{ds}T_{ds}T_{eo}{}^mC_{eo}{}^mC_{es}A_{es}G_e$ | 14 | 44 |
| 650384 | 271 | 288 | 11532 | 11549 | $A_{es}{}^mC_{eo}{}^mC_{eo}A_{eo}{}^mC_{es}T_{ds}G_{ds}T_{ds}{}^mC_{ds}A_{ds}T_{ds}{}^mC_{ds}{}^mC_{ds}A_{eo}T_{eo}A_{es}T_{es}T_e$ | 29 | 45 |
| 650385 | 294 | 311 | N/A | N/A | ${}^mC_{es}T_{eo}T_{eo}A_{eo}T_{es}A_{ds}A_{ds}{}^mC_{ds}T_{ds}G_{ds}A_{ds}A_{ds}T_{eo}A_{eo}G_{es}A_{es}G_e$ | 9 | 46 |
| 650386 | 320 | 337 | 13842 | 13859 | ${}^mC_{es}T_{eo}A_{eo}A_{eo}A_{es}{}^mC_{ds}{}^mC_{ds}{}^mC_{ds}{}^mC_{ds}A_{ds}A_{ds}A_{ds}{}^mC_{ds}T_{eo}T_{eo}T_{es}{}^mC_{es}A_e$ | 30 | 47 |
| 650387 | 325 | 342 | 13847 | 13864 | $T_{es}A_{eo}G_{eo}T_{eo}T_{es}{}^mC_{ds}T_{ds}A_{ds}A_{ds}A_{ds}{}^mC_{ds}{}^mC_{ds}{}^mC_{ds}{}^mC_{eo}A_{eo}A_{es}A_{es}{}^mC_e$ | 0 | 48 |
| 650388 | 330 | 347 | 13852 | 13869 | $A_{es}G_{eo}A_{eo}A_{eo}T_{es}T_{ds}A_{ds}G_{ds}T_{ds}T_{ds}{}^mC_{ds}T_{ds}A_{ds}A_{eo}A_{eo}{}^mC_{es}{}^mC_{es}{}^mC_e$ | 15 | 49 |
| 650389 | 335 | 352 | 13857 | 13874 | $T_{es}G_{eo}A_{eo}A_{eo}{}^mC_{es}A_{ds}G_{ds}G_{ds}A_{ds}T_{ds}T_{ds}A_{ds}G_{ds}T_{eo}T_{eo}{}^mC_{es}T_{es}A_e$ | 2 | 50 |
| 650390 | 340 | 357 | 13862 | 13879 | $A_{es}{}^mC_{eo}T_{eo}G_{eo}T_{es}T_{ds}G_{ds}A_{ds}A_{ds}{}^mC_{ds}A_{ds}G_{ds}G_{ds}A_{eo}T_{eo}T_{es}A_{es}G_e$ | 33 | 51 |
| 650391 | 345 | 362 | 13867 | 13884 | $T_{es}{}^mC_{eo}T_{eo}G_{eo}G_{es}A_{ds}{}^mC_{ds}T_{ds}G_{ds}T_{ds}T_{ds}G_{ds}A_{ds}A_{eo}{}^mC_{eo}A_{es}G_{es}G_e$ | 11 | 52 |
| 650392 | 349 | 366 | 13871 | 13888 | $A_{es}T_{eo}A_{eo}{}^mC_{eo}T_{es}{}^mC_{ds}T_{ds}G_{ds}G_{ds}A_{ds}{}^mC_{ds}T_{ds}G_{ds}T_{eo}T_{eo}G_{es}A_{es}A_e$ | 23 | 53 |
| 650393 | 372 | 389 | 13894 | 13911 | $A_{es}T_{eo}A_{co}G_{eo}G_{es}A_{ds}T_{ds}{}^mC_{ds}G_{ds}A_{ds}T_{ds}{}^mC_{ds}{}^mC_{ds}T_{eo}G_{eo}A_{es}G_{es}{}^mC_e$ | 39 | 54 |
| 650394 | 404 | 421 | 14353 | 14370 | ${}^mC_{es}{}^mC_{eo}{}^mC_{eo}T_{eo}T_{es}A_{ds}T_{ds}A_{ds}A_{ds}T_{ds}T_{ds}G_{ds}{}^mC_{ds}A_{ds}T_{eo}A_{eo}T_{es}A_{es}A_e$ | 24 | 55 |
| 650395 | 422 | 439 | 14371 | 14388 | $T_{es}A_{eo}A_{eo}{}^mC_{eo}T_{es}G_{ds}T_{ds}A_{ds}A_{ds}A_{ds}{}^mC_{ds}{}^mC_{ds}T_{ds}A_{ds}G_{eo}T_{eo}G_{es}T_{es}T_e$ | 8 | 56 |
| 650396 | 432 | 449 | 14381 | 14398 | ${}^mC_{es}{}^mC_{eo}T_{eo}A_{eo}A_{es}T_{ds}T_{ds}T_{ds}T_{ds}{}^mC_{ds}T_{ds}A_{ds}A_{ds}{}^mC_{eo}T_{eo}G_{es}T_{es}A_e$ | 0 | 57 |
| 650397 | 433 | 450 | 14382 | 14399 | $T_{es}{}^mC_{eo}{}^mC_{eo}T_{eo}A_{es}A_{ds}T_{ds}T_{ds}T_{ds}T_{ds}{}^mC_{ds}T_{ds}A_{ds}A_{eo}{}^mC_{eo}T_{es}G_{es}T_e$ | 13 | 58 |
| 650398 | 454 | 471 | 18837 | 18854 | $A_{es}T_{eo}T_{eo}{}^mC_{eo}A_{es}A_{ds}G_{ds}T_{ds}T_{ds}A_{ds}A_{ds}A_{ds}{}^mC_{ds}{}^mC_{eo}A_{eo}{}^mC_{es}T_{es}G_e$ | 34 | 59 |
| 650399 | 459 | 476 | 18842 | 18859 | $A_{es}G_{eo}A_{eo}G_{eo}A_{es}A_{ds}T_{ds}T_{ds}{}^mC_{ds}A_{ds}A_{ds}G_{ds}T_{ds}T_{eo}A_{eo}A_{es}A_{es}{}^mC_e$ | 5 | 60 |
| 650400 | 462 | 479 | 18845 | 18862 | $A_{es}A_{eo}G_{eo}A_{eo}G_{es}A_{ds}G_{ds}A_{ds}A_{ds}T_{ds}T_{ds}{}^mC_{ds}A_{ds}A_{eo}G_{eo}T_{es}T_{es}A_e$ | 17 | 61 |
| 650401 | 478 | 495 | 18861 | 18878 | $T_{es}A_{eo}A_{eo}T_{eo}T_{es}{}^mC_{ds}T_{ds}G_{ds}G_{ds}A_{ds}{}^mC_{ds}{}^mC_{ds}{}^mC_{ds}G_{eo}T_{eo}{}^mC_{es}A_{es}A_e$ | 25 | 62 |
| 650402 | 483 | 500 | 18866 | 18883 | $G_{es}A_{eo}A_{eo}A_{es}T_{ds}A_{ds}A_{ds}T_{ds}T_{ds}{}^mC_{ds}T_{ds}G_{ds}G_{eo}A_{eo}{}^mC_{es}{}^mC_{es}{}^mC_e$ | 47 | 63 |
| 650403 | 489 | 506 | 18872 | 18889 | $G_{es}T_{eo}A_{eo}T_{eo}{}^mC_{es}T_{ds}G_{ds}A_{ds}A_{ds}T_{ds}T_{ds}T_{ds}A_{ds}A_{eo}T_{eo}T_{es}{}^mC_{es}T_e$ | 6 | 64 |
| 650404 | 494 | 511 | 18877 | 18894 | $G_{es}A_{eo}A_{eo}A_{eo}T_{es}G_{ds}T_{ds}A_{ds}T_{ds}{}^mC_{ds}T_{ds}G_{ds}A_{ds}T_{eo}A_{eo}T_{es}T_{es}A_e$ | 19 | 65 |
| 650405 | 517 | 534 | 18900 | 18917 | $T_{es}A_{c}A_{eo}T_{eo}T_{es}G_{ds}A_{ds}A_{ds}{}^mC_{ds}{}^mC_{ds}A_{ds}A_{ds}G_{ds}G_{eo}A_{eo}A_{es}A_{es}G_e$ | 0 | 66 |
| 650406 | 540 | 557 | N/A | N/A | $A_{es}A_{eo}T_{eo}A_{eo}T_{es}A_{ds}G_{ds}A_{ds}A_{ds}T_{ds}A_{ds}A_{ds}{}^mC_{ds}{}^mC_{eo}T_{eo}T_{es}{}^mC_{es}{}^mC_e$ | 17 | 67 |
| 650407 | 542 | 559 | N/A | N/A | ${}^mC_{es}A_{eo}A_{eo}A_{eo}T_{es}A_{ds}T_{ds}A_{ds}G_{ds}A_{ds}A_{ds}T_{ds}A_{ds}A_{eo}{}^mC_{eo}{}^mC_{es}T_{es}T_e$ | 2 | 68 |
| 650408 | 562 | 579 | 24416 | 24433 | $T_{es}G_{eo}G_{eo}{}^mC_{eo}A_{es}G_{ds}A_{ds}T_{ds}{}^mC_{ds}A_{ds}{}^mC_{ds}{}^mC_{ds}{}^mC_{ds}T_{eo}T_{eo}A_{es}A_{es}{}^mC_e$ | 19 | 69 |
| 650409 | 567 | 584 | 24421 | 24438 | ${}^mC_{es}A_{eo}A_{eo}T_{eo}{}^mC_{es}T_{ds}G_{ds}G_{ds}{}^mC_{ds}A_{ds}G_{ds}A_{ds}T_{ds}{}^mC_{eo}A_{eo}{}^mC_{es}{}^mC_{es}{}^mC_e$ | 30 | 70 |

TABLE 1-continued

Percent reduction of human ATXN3 mRNA by modified oligonucleotides relative to control

| IONIS No | SEQ ID No: 1 Start Site | SEQ ID No: 1 Stop Site | SEQ ID No: 2 Start Site | SEQ ID No: 2 Stop Site | Sequence (5' to 3') | % Inhib. | SEQ ID No |
|---|---|---|---|---|---|---|---|
| 650410 | 568 | 585 | 24422 | 24439 | $G_{es}{}^mC_{eo}A_{eo}A_{eo}T_{es}{}^mC_{ds}T_{ds}G_{ds}G_{ds}{}^mC_{ds}A_{ds}G_{ds}A_{ds}T_{eo}{}^mC_{eo}A_{es}{}^mC_{es}{}^mC_e$ | 57 | 71 |
| 650411 | 591 | 608 | 24445 | 24462 | $A_{es}T_{eo}{}^mC_{eo}T_{eo}G_{es}{}^mC_{ds}A_{ds}G_{ds}G_{ds}A_{ds}G_{ds}T_{ds}T_{ds}G_{eo}G_{eo}T_{es}{}^mC_{es}A_e$ | 12 | 72 |
| 650412 | 614 | 631 | 24468 | 24485 | $G_{es}A_{eo}T_{eo}G_{eo}{}^mC_{es}A_{ds}T_{ds}{}^mC_{ds}T_{ds}G_{ds}T_{ds}T_{ds}G_{ds}G_{eo}A_{eo}{}^mC_{es}{}^mC_{es}{}^mC_e$ | 45 | 73 |
| 650413 | 615 | 632 | 24469 | 24486 | ${}^mC_{es}G_{eo}A_{eo}T_{eo}G_{es}{}^mC_{ds}A_{ds}T_{ds}{}^mC_{ds}T_{ds}G_{ds}T_{ds}T_{ds}G_{eo}G_{eo}A_{es}{}^mC_{es}{}^mC_e$ | 41 | 74 |
| 650414 | 620 | 637 | 24474 | 24491 | $T_{es}T_{eo}G_{eo}G_{eo}T_{es}{}^mC_{ds}G_{ds}A_{ds}T_{ds}G_{ds}{}^mC_{ds}A_{ds}A_{ds}{}^mC_{ds}{}^mC_{eo}T_{eo}G_{es}T_{es}T_e$ | 41 | 75 |
| 650415 | 625 | 642 | 24479 | 24496 | $A_{es}A_{eo}G_{eo}T_{eo}T_{es}T_{ds}T_{ds}G_{ds}G_{ds}T_{ds}{}^mC_{ds}G_{ds}A_{ds}T_{eo}G_{eo}{}^mC_{es}A_{es}T_e$ | 0 | 76 |
| 650416 | 630 | 647 | 24484 | 24501 | ${}^mC_{es}{}^mC_{eo}A_{eo}A_{eo}T_{es}A_{ds}A_{ds}G_{ds}T_{ds}T_{ds}T_{ds}T_{ds}G_{ds}G_{eo}T_{eo}{}^mC_{es}G_{es}A_e$ | 23 | 77 |
| 650417 | 638 | 655 | 24492 | 24509 | $A_{es}T_{eo}T_{eo}{}^mC_{eo}T_{es}T_{ds}{}^mC_{ds}T_{ds}{}^mC_{ds}{}^mC_{ds}A_{ds}A_{ds}T_{ds}A_{eo}A_{eo}G_{es}T_{es}T_e$ | 0 | 78 |
| 650418 | 661 | 678 | N/A | N/A | $T_{es}{}^mC_{eo}T_{eo}T_{eo}T_{es}G_{ds}{}^mC_{ds}T_{ds}{}^mC_{ds}T_{ds}T_{ds}T_{ds}T_{ds}A_{eo}G_{eo}T_{es}T_{es}G_e$ | 26 | 79 |
| 650419 | 684 | 701 | 25197 | 25214 | ${}^mC_{es}G_{eo}T_{eo}T_{eo}{}^mC_{es}{}^mC_{ds}A_{ds}G_{ds}G_{ds}T_{ds}{}^mC_{ds}T_{ds}G_{ds}T_{eo}T_{eo}T_{es}T_{es}A_e$ | 47 | 80 |
| 650420 | 708 | 725 | 25221 | 25238 | $G_{es}A_{eo}G_{eo}{}^mC_{eo}{}^mC_{es}A_{ds}T_{ds}{}^mC_{ds}A_{ds}A_{ds}T_{ds}T_{ds}T_{ds}G_{ds}{}^mC_{eo}T_{eo}T_{es}{}^mC_{es}T_e$ | 37 | 81 |
| 650421 | 738 | 755 | 25251 | 25268 | $A_{es}A_{c}A_{c}T_{eo}{}^mC_{es}{}^mC_{ds}T_{ds}{}^mC_{ds}{}^mC_{ds}T_{ds}{}^mC_{ds}A_{ds}T_{ds}{}^mC_{eo}T_{eo}T_{es}{}^mC_{es}G_e$ | 7 | 82 |
| 650422 | 761 | 778 | 25274 | 25291 | $G_{es}A_{eo}{}^mC_{eo}T_{eo}A_{es}G_{ds}T_{ds}G_{ds}{}^mC_{ds}{}^mC_{ds}A_{ds}G_{ds}A_{eo}G_{eo}{}^mC_{es}{}^mC_{es}{}^mC_e$ | 17 | 83 |
| 650423 | 787 | 804 | 25300 | 25317 | ${}^mC_{es}T_{eo}{}^mC_{eo}A_{eo}T_{es}{}^mC_{ds}T_{ds}T_{ds}{}^mC_{ds}{}^mC_{ds}A_{ds}T_{ds}G_{ds}T_{eo}{}^mC_{eo}A_{es}A_{es}T_e$ | 0 | 84 |
| 650424 | 810 | 827 | 25323 | 25340 | $A_{es}T_{eo}A_{eo}G_{eo}{}^mC_{es}T_{ds}{}^mC_{ds}T_{ds}G_{ds}{}^mC_{ds}G_{ds}G_{ds}A_{ds}G_{eo}A_{eo}T_{es}{}^mC_{es}T_e$ | 12 | 85 |
| 650425 | 833 | 850 | N/A | N/A | $A_{es}A_{eo}{}^mC_{eo}T_{eo}A_{es}{}^mC_{ds}T_{ds}T_{ds}G_{ds}{}^mC_{ds}A_{ds}T_{ds}A_{eo}{}^mC_{eo}T_{es}T_{es}A_e$ | 31 | 86 |
| 650426 | 835 | 852 | N/A | N/A | $G_{es}G_{eo}A_{eo}A_{eo}{}^mC_{es}T_{ds}A_{ds}{}^mC_{ds}T_{ds}T_{ds}G_{ds}{}^mC_{ds}A_{ds}T_{eo}A_{es}{}^mC_{es}T_e$ | 33 | 87 |
| 650427 | 856 | 873 | 26607 | 26624 | ${}^mC_{es}A_{eo}T_{eo}A_{eo}T_{es}{}^mC_{ds}T_{ds}T_{ds}G_{ds}A_{ds}G_{ds}A_{ds}T_{ds}A_{eo}T_{eo}G_{es}T_{es}T_e$ | 48 | 88 |
| 650428 | 879 | 896 | 26630 | 26647 | $A_{es}G_{eo}T_{eo}T_{es}T_{ds}G_{ds}T_{ds}A_{ds}{}^mC_{ds}{}^mC_{ds}T_{ds}G_{ds}A_{eo}T_{eo}G_{es}T_{es}{}^mC_e$ | 20 | 89 |
| 650429 | 902 | 919 | 26653 | 26670 | $T_{es}{}^mC_{eo}T_{eo}T_{eo}{}^mC_{es}{}^mC_{ds}G_{ds}A_{ds}A_{ds}G_{ds}{}^mC_{ds}T_{ds}{}^mC_{ds}T_{eo}T_{eo}{}^mC_{es}T_{es}G_e$ | 3 | 90 |
| 650430 | 922 | 939 | 26673 | 26690 | $T_{es}T_{eo}T_{eo}{}^mC_{eo}A_{es}A_{es}G_{ds}T_{ds}A_{ds}G_{ds}G_{ds}{}^mC_{ds}T_{ds}T_{eo}{}^mC_{eo}T_{es}{}^mC_{es}G_e$ | 47 | 91 |
| 650431 | 925 | 942 | N/A | N/A | $T_{es}T_{eo}T_{eo}T_{eo}T_{es}{}^mC_{ds}A_{ds}A_{ds}A_{ds}G_{ds}T_{ds}A_{ds}G_{ds}G_{eo}{}^mC_{eo}T_{es}T_{es}{}^mC_e$ | 0 | 92 |
| 650432* | 976 | 993 | 36638 | 36655 | $T_{es}A_{eo}G_{eo}G_{eo}T_{es}{}^mC_{ds}{}^mC_{ds}{}^mC_{ds}{}^mC_{ds}{}^mC_{ds}T_{ds}G_{ds}{}^mC_{ds}T_{eo}G_{eo}{}^mC_{es}T_{es}G_e$ | 68 | 93 |
| 650433* | 999 | 1016 | 36661 | 36678 | ${}^mC_{es}A_{eo}T_{eo}G_{eo}G_{es}A_{ds}T_{ds}G_{ds}T_{ds}G_{ds}A_{ds}A_{ds}{}^mC_{ds}T_{eo}{}^mC_{eo}T_{es}G_{es}T_e$ | 21 | 94 |
| 650434* | 1022 | 1039 | 36684 | 36701 | ${}^mC_{es}T_{eo}G_{eo}A_{eo}A_{es}{}^mC_{ds}T_{ds}G_{ds}G_{ds}T_{ds}G_{ds}G_{ds}{}^mC_{ds}T_{eo}G_{eo}G_{es}{}^mC_{es}{}^mC_e$ | 49 | 95 |
| 650435* | 1045 | 1062 | 36707 | 36724 | $A_{es}{}^mC_{eo}{}^mC_{eo}T_{eo}A_{es}G_{ds}A_{ds}T_{ds}{}^mC_{ds}A_{ds}T_{ds}T_{ds}{}^mC_{ds}{}^mC_{eo}{}^mC_{eo}A_{es}A_{es}G_e$ | 12 | 96 |
| 650436* | 1068 | 1085 | 43250 | 43267 | $A_{es}T_{eo}G_{eo}T_{eo}{}^mC_{es}T_{ds}T_{ds}{}^mC_{ds}T_{ds}T_{ds}{}^mC_{ds}A_{ds}T_{ds}{}^mC_{eo}T_{eo}{}^mC_{eo}A_{es}T_{es}A_e$ | 32 | 97 |
| 650437 | 1091 | 1108 | 43273 | 43290 | $A_{es}{}^mC_{eo}A_{eo}T_{eo}G_{es}T_{ds}{}^mC_{ds}A_{ds}{}^mC_{ds}A_{ds}G_{ds}{}^mC_{ds}T_{eo}G_{eo}{}^mC_{es}{}^mC_{es}T_e$ | 67 | 98 |
| 650438 | 1092 | 1109 | 43274 | 43291 | $G_{es}A_{eo}{}^mC_{eo}A_{eo}T_{es}G_{ds}T_{ds}{}^mC_{ds}A_{ds}{}^mC_{ds}A_{ds}G_{ds}{}^mC_{eo}T_{eo}G_{es}{}^mC_{es}{}^mC_e$ | 69 | 99 |
| 650439 | 1097 | 1114 | 43279 | 43296 | ${}^mC_{es}T_{eo}A_{eo}A_{eo}A_{es}G_{ds}A_{ds}{}^mC_{ds}A_{ds}T_{ds}G_{ds}G_{ds}T_{ds}{}^mC_{eo}A_{eo}{}^mC_{es}A_{es}G_e$ | 36 | 100 |
| 650440 | 1102 | 1119 | 43284 | 43301 | $A_{es}G_{eo}T_{eo}T_{eo}T_{es}{}^mC_{ds}T_{ds}A_{ds}A_{ds}A_{ds}G_{ds}A_{ds}{}^mC_{ds}A_{eo}T_{eo}G_{es}G_{es}T_e$ | 40 | 101 |
| 650441 | 1114 | 1131 | 43296 | 43313 | $A_{es}T_{eo}{}^mC_{eo}A_{eo}T_{es}T_{ds}T_{ds}{}^mC_{ds}T_{ds}G_{ds}A_{ds}{}^mC_{ds}A_{ds}G_{eo}T_{eo}T_{es}T_{es}{}^mC_e$ | 31 | 102 |
| 650442 | 1173 | 1190 | 43355 | 43372 | $G_{es}A_{eo}A_{eo}A_{eo}G_{es}T_{ds}A_{ds}T_{ds}G_{ds}A_{ds}A_{ds}T_{ds}A_{ds}T_{eo}{}^mC_{eo}T_{es}A_{es}A_e$ | 27 | 103 |
| 650443 | 1196 | 1213 | 43378 | 43395 | $T_{es}G_{eo}T_{eo}A_{eo}A_{es}T_{ds}{}^mC_{ds}A_{ds}A_{ds}{}^mC_{ds}A_{ds}A_{ds}G_{ds}G_{eo}A_{eo}T_{es}A_{es}A_e$ | 35 | 104 |
| 650444 | 1219 | 1236 | 43401 | 43418 | ${}^mC_{es}A_{eo}T_{eo}T_{eo}A_{es}{}^mC_{ds}{}^mC_{ds}A_{ds}A_{ds}A_{ds}G_{ds}T_{ds}G_{ds}G_{eo}A_{eo}{}^mC_{es}{}^mC_{es}{}^mC_e$ | 18 | 105 |
| 650445 | 1250 | 126" | 43432 | 43449 | ${}^mC_{es}T_{eo}A_{eo}A_{eo}A_{es}A_{ds}G_{ds}T_{ds}{}^mC_{ds}T_{ds}T_{ds}A_{ds}T_{ds}T_{eo}T_{eo}{}^mC_{es}{}^mC_{es}T_e$ | 17 | 106 |
| 650446 | 1279 | 1296 | 43461 | 43478 | ${}^mC_{es}A_{eo}{}^mC_{eo}T_{eo}T_{es}T_{ds}{}^mC_{ds}{}^mC_{ds}{}^mC_{ds}{}^mC_{ds}A_{ds}T_{ds}{}^mC_{ds}A_{ds}T_{eo}T_{eo}T_{es}T_{es}G_e$ | 17 | 107 |

TABLE 1-continued

Percent reduction of human ATXN3 mRNA by modified oligonucleotides relative to control

| IONIS No | SEQ ID No: 1 Start Site | SEQ ID No: 1 Stop Site | SEQ ID No: 2 Start Site | SEQ ID No: 2 Stop Site | Sequence (5' to 3') | % Inhib. | SEQ ID No |
|---|---|---|---|---|---|---|---|
| 650447 | 1302 | 1319 | 43484 | 43501 | $G_{es}T_{eo}{}^mC_{eo}{}^mC_{es}T_{es}A_{ds}{}^mC_{ds}A_{ds}A_{ds}{}^mC_{ds}{}^mC_{ds}G_{ds}A_{ds}{}^mC_{eo}G_{eo}{}^mC_{es}A_{es}T_e$ | 21 | 108 |
| 650448 | 1327 | 1344 | 43509 | 43526 | ${}^mC_{es}T_{eo}A_{eo}A_{eo}T_{es}A_{ds}T_{ds}T_{ds}T_{ds}G_{ds}G_{ds}A_{ds}A_{ds}G_{eo}A_{eo}T_{es}{}^mC_{es}A_e$ | 39 | 109 |
| 650449 | 1350 | 136" | 43532 | 43549 | $T_{es}T_{eo}A_{eo}A_{eo}T_{es}T_{ds}G_{ds}{}^mC_{ds}T_{ds}G_{ds}A_{ds}A_{ds}T_{ds}G_{eo}{}^mC_{eo}{}^mC_{es}T_{es}{}^mC_e$ | 51 | 110 |
| 650450 | 1402 | 1419 | 43584 | 43601 | $T_{es}T_{eo}G_{eo}{}^mC_{eo}A_{es}{}^mC_{ds}A_{ds}{}^mC_{ds}T_{ds}{}^mC_{ds}A_{ds}A_{ds}A_{ds}A_{eo}A_{eo}A_{es}G_{es}A_e$ | 21 | 111 |
| 650451 | 1425 | 1442 | 43607 | 43624 | ${}^mC_{es}{}^mC_{eo}T_{eo}A_{eo}A_{es}{}^mC_{ds}T_{ds}T_{ds}T_{ds}A_{ds}G_{ds}A_{ds}{}^mC_{ds}A_{eo}T_{eo}G_{es}T_{es}T_e$ | 15 | 112 |
| 650452 | 1450 | 1467 | 43632 | 43649 | ${}^mC_{es}T_{eo}G_{eo}{}^mC_{eo}A_{es}A_{ds}A_{ds}A_{ds}A_{ds}G_{ds}A_{ds}T_{ds}{}^mC_{ds}{}^mC_{eo}A_{eo}A_{es}G_{es}A_e$ | 20 | 113 |
| 650453 | 1473 | 1490 | 43655 | 43672 | $G_{es}A_{eo}G_{eo}G_{eo}{}^mC_{es}G_{ds}A_{ds}G_{ds}A_{ds}G_{ds}{}^mC_{ds}T_{ds}A_{ds}A_{eo}T_{eo}T_{es}A_{es}G_e$ | 17 | 114 |
| 650454 | 1518 | 1535 | 43700 | 43717 | $T_{es}A_{eo}{}^mC_{eo}{}^mC_{eo}T_{es}A_{ds}{}^mC_{ds}A_{ds}A_{ds}G_{ds}A_{ds}{}^mC_{ds}A_{ds}G_{eo}A_{eo}A_{es}A_{es}A_e$ | 12 | 115 |
| 650455 | 1541 | 1558 | 43723 | 43740 | ${}^mC_{es}T_{eo}A_{eo}T_{eo}T_{es}A_{ds}{}^mC_{ds}A_{ds}T_{ds}G_{ds}A_{ds}T_{ds}G_{ds}T_{eo}G_{eo}A_{es}G_{es}{}^mC_e$ | 13 | 116 |
| 650456 | 1564 | 1581 | 43746 | 43763 | $T_{es}G_{eo}G_{eo}T_{eo}T_{es}A_{ds}A_{ds}T_{ds}A_{ds}A_{ds}G_{ds}A_{ds}A_{ds}A_{eo}T_{eo}G_{es}A_{es}A_e$ | 0 | 117 |
| 650457 | 1588 | 1605 | 43770 | 43787 | $A_{es}G_{eo}A_{eo}T_{eo}A_{es}{}^mC_{ds}T_{ds}T_{ds}T_{ds}{}^mC_{ds}{}^mC_{ds}T_{ds}G_{ds}A_{eo}A_{eo}A_{es}G_{es}G_e$ | 0 | 118 |
| 650458 | 1613 | 1630 | 43795 | 43812 | $A_{es}{}^mC_{eo}T_{eo}A_{eo}T_{es}A_{ds}T_{ds}{}^mC_{ds}A_{ds}A_{ds}{}^mC_{ds}A_{ds}T_{eo}{}^mC_{eo}A_{eo}G_{es}G_e$ | 6 | 119 |
| 650459 | 1636 | 1653 | 43818 | 43835 | ${}^mC_{es}T_{eo}G_{eo}T_{eo}T_{es}{}^mC_{ds}A_{ds}T_{ds}{}^mC_{ds}{}^mC_{ds}T_{ds}T_{ds}{}^mC_{ds}T_{eo}A_{eo}G_{es}A_{es}A_e$ | 15 | 120 |
| 650460 | 1659 | 1676 | 43841 | 43858 | $A_{es}{}^mC_{eo}G_{eo}G_{eo}T_{es}A_{ds}T_{ds}A_{ds}{}^mC_{ds}A_{ds}G_{ds}T_{ds}T_{ds}G_{eo}A_{eo}A_{es}G_{es}G_e$ | 8 | 121 |
| 650461 | 1695 | 1712 | 43877 | 43894 | $G_{es}A_{eo}T_{eo}{}^mC_{eo}A_{es}G_{ds}A_{ds}G_{ds}A_{ds}A_{ds}A_{ds}{}^mC_{ds}A_{eo}A_{eo}{}^mC_{es}A_{es}{}^mC_e$ | 18 | 122 |
| 650462 | 1720 | 1737 | 43902 | 43919 | $G_{es}A_{eo}A_{eo}A_{eo}A_{es}{}^mC_{ds}{}^mC_{ds}A_{ds}G_{ds}G_{ds}T_{ds}A_{ds}G_{ds}{}^mC_{eo}A_{eo}G_{es}A_{es}A_e$ | 15 | 123 |
| 650463 | 1743 | 1760 | 43925 | 43942 | ${}^mC_{es}A_{eo}A_{eo}A_{eo}A_{es}G_{ds}A_{ds}A_{ds}A_{ds}T_{ds}T_{ds}G_{ds}T_{ds}G_{ds}G_{eo}G_{eo}A_{es}A_{es}A_e$ | 11 | 124 |
| 650464 | 1766 | 1783 | 43948 | 43965 | ${}^mC_{es}{}^mC_{eo}T_{eo}{}^mC_{eo}{}^mC_{es}A_{ds}G_{ds}A_{ds}A_{ds}A_{ds}A_{ds}G_{ds}A_{ds}T_{ds}T_{eo}A_{eo}{}^mC_{es}{}^mC_{es}A_e$ | 29 | 125 |
| 650465 | 1803 | 1820 | 43985 | 44002 | $G_{es}A_{eo}A_{eo}A_{eo}T_{es}A_{ds}A_{ds}T_{ds}G_{ds}A_{ds}A_{ds}T_{ds}{}^mC_{ds}T_{ds}{}^mC_{ds}{}^mC_{eo}A_{eo}T_{es}{}^mC_{es}G_e$ | 2 | 126 |
| 650466 | 1826 | 1843 | 44008 | 44025 | $G_{es}A_{eo}G_{eo}T_{eo}T_{es}T_{ds}A_{ds}G_{ds}G_{ds}A_{ds}A_{ds}{}^mC_{ds}A_{ds}G_{ds}{}^mC_{eo}A_{eo}{}^mC_{es}{}^mC_{es}A_e$ | 57 | 127 |
| 650467 | 1849 | 1866 | 44031 | 44048 | $G_{es}T_{eo}A_{eo}{}^mC_{eo}T_{es}T_{ds}G_{ds}T_{ds}G_{ds}{}^mC_{ds}A_{ds}A_{ds}G_{ds}G_{eo}{}^mC_{eo}T_{es}G_{es}A_e$ | 33 | 128 |
| 650468 | 1891 | 1908 | 44073 | 44090 | $G_{es}{}^mC_{eo}A_{eo}{}^mC_{eo}A_{es}T_{ds}G_{ds}{}^mC_{ds}T_{ds}{}^mC_{ds}A_{ds}{}^mC_{ds}A_{ds}{}^mC_{eo}A_{eo}T_{es}T_{es}T_e$ | 34 | 129 |
| 650469 | 1915 | 1932 | 44097 | 44114 | $G_{es}A_{eo}{}^mC_{eo}A_{eo}T_{es}T_{ds}{}^mC_{ds}A_{ds}T_{ds}A_{ds}A_{ds}A_{ds}G_{ds}{}^mC_{eo}A_{eo}T_{es}{}^mC_{es}T_e$ | 14 | 130 |
| 650470 | 1938 | 1955 | 44120 | 44137 | $T_{es}A_{eo}A_{eo}G_{eo}T_{es}T_{ds}T_{ds}T_{ds}T_{ds}G_{ds}A_{ds}T_{ds}A_{ds}T_{eo}A_{eo}A_{es}G_{es}T_e$ | 0 | 131 |
| 650471 | 1971 | 1988 | 44153 | 44170 | $A_{es}A_{eo}G_{eo}G_{eo}{}^mC_{es}G_{ds}{}^mC_{ds}A_{ds}G_{ds}G_{ds}G_{ds}A_{ds}A_{ds}G_{ds}A_{eo}G_{eo}G_{es}G_{es}G_e$ | 19 | 132 |
| 650472 | 1996 | 2013 | 44178 | 44195 | $T_{es}{}^mC_{eo}A_{eo}A_{eo}T_{es}T_{ds}G_{ds}G_{ds}A_{ds}A_{ds}A_{ds}G_{ds}A_{eo}A_{eo}A_{es}G_{es}G_e$ | 2 | 133 |
| 650473 | 2019 | 2036 | 44201 | 44218 | $A_{es}T_{eo}A_{eo}{}^mC_{eo}T_{es}A_{ds}T_{ds}G_{ds}{}^mC_{ds}T_{ds}T_{ds}{}^mC_{ds}T_{ds}{}^mC_{eo}{}^mC_{eo}T_{es}A_{es}G_e$ | 6 | 134 |
| 650474 | 2042 | 2059 | 44224 | 44241 | ${}^mC_{es}T_{eo}A_{eo}A_{eo}{}^mC_{es}A_{ds}G_{ds}A_{ds}A_{ds}G_{ds}G_{ds}A_{ds}A_{ds}{}^mC_{eo}T_{es}T_{es}G_e$ | 18 | 135 |
| 650475 | 2073 | 2090 | 44255 | 44272 | $A_{es}{}^mC_{eo}A_{eo}T_{eo}T_{es}{}^mC_{ds}A_{ds}T_{ds}G_{ds}G_{ds}I_{ds}G_{ds}G_{ds}{}^mC_{eo}T_{eo}A_{es}{}^mC_{es}G_e$ | 19 | 136 |
| 650476 | 2096 | 2113 | 44278 | 44295 | $G_{es}A_{eo}A_{eo}G_{eo}G_{es}{}^mC_{ds}{}^mC_{ds}A_{ds}A_{ds}A_{ds}T_{ds}T_{ds}{}^mC_{eo}A_{eo}T_{es}G_{es}T_e$ | 29 | 137 |
| 650477 | 2141 | 2158 | 44323 | 44340 | ${}^mC_{es}T_{eo}{}^mC_{eo}{}^mC_{eo}G_{es}T_{ds}{}^mC_{ds}A_{ds}T_{ds}A_{ds}G_{ds}G_{ds}A_{eo}G_{eo}A_{es}A_{es}A_e$ | 32 | 138 |
| 650478 | 2166 | 2183 | 44348 | 44365 | $A_{es}{}^mC_{eo}T_{eo}{}^mC_{eo}A_{es}A_{ds}{}^mC_{ds}T_{ds}{}^mC_{ds}G_{ds}T_{ds}A_{ds}A_{ds}A_{ds}G_{eo}A_{eo}G_{es}A_{es}A_e$ | 36 | 139 |
| 650479 | 2189 | 2206 | 44371 | 44388 | $G_{es}A_{eo}A_{eo}G_{eo}{}^mC_{es}A_{ds}G_{ds}A_{ds}{}^mC_{ds}A_{ds}{}^mC_{ds}{}^mC_{ds}T_{ds}A_{eo}{}^mC_{eo}A_{es}T_{es}T_e$ | 0 | 140 |
| 650480 | 2213 | 2230 | 44395 | 44412 | ${}^mC_{es}A_{eo}A_{eo}G_{eo}{}^mC_{es}T_{ds}A_{ds}T_{ds}A_{ds}{}^mC_{ds}{}^mC_{ds}T_{ds}A_{ds}{}^mC_{eo}T_{eo}A_{es}A_{es}A_e$ | 0 | 141 |
| 650481 | 2236 | 2253 | 44418 | 44435 | $A_{es}T_{eo}G_{eo}T_{eo}T_{es}{}^mC_{ds}{}^mC_{ds}A_{ds}G_{ds}G_{ds}A_{ds}T_{ds}{}^mC_{ds}A_{ds}{}^mC_{eo}{}^mC_{eo}A_{es}T_{es}{}^mC_e$ | 34 | 142 |
| 650482 | 2279 | 2296 | 44461 | 44478 | ${}^mC_{es}A_{eo}{}^mC_{eo}A_{eo}G_{es}T_{ds}A_{ds}T_{ds}A_{ds}A_{ds}A_{ds}T_{ds}T_{ds}T_{eo}A_{eo}A_{es}A_{es}{}^mC_e$ | 4 | 143 |

TABLE 1-continued

Percent reduction of human ATXN3 mRNA by modified oligonucleotides relative to control

| IONIS No | SEQ ID No: 1 Start Site | SEQ ID No: 1 Stop Site | SEQ ID No: 2 Start Site | SEQ ID No: 2 Stop Site | Sequence (5' to 3') | % Inhib. | SEQ ID No |
|---|---|---|---|---|---|---|---|
| 650483 | 2302 | 2319 | 44484 | 44501 | $T_{es}A_{eo}A_{eo}A_{eo}{}^mC_{es}A_{ds}T_{ds}G_{ds}A_{ds}T_{ds}G_{ds}{}^mC_{ds}A_{ds}A_{eo}G_{eo}T_{es}G_{es}T_e$ | 3 | 144 |
| 650484 | 2325 | 2342 | 44507 | 44524 | $A_{es}{}^mC_{eo}T_{eo}T_{eo}{}^mC_{es}{}^mC_{ds}A_{ds}T_{ds}T_{ds}G_{ds}T_{ds}T_{ds}{}^mC_{ds}T_{eo}T_{eo}A_{es}A_{es}G_e$ | 31 | 145 |
| 650485 | 2348 | 2365 | 44530 | 44547 | $T_{es}T_{eo}A_{eo}T_{eo}A_{es}G_{ds}A_{ds}T_{ds}{}^mC_{ds}{}^mC_{ds}A_{ds}{}^mC_{ds}T_{ds}A_{eo}A_{eo}G_{es}T_{es}A_e$ | 3 | 146 |
| 650486 | 2371 | 2388 | 44553 | 44570 | $A_{es}T_{eo}{}^mC_{eo}A_{eo}A_{es}A_{ds}A_{ds}{}^mC_{ds}T_{ds}A_{ds}T_{ds}G_{ds}G_{ds}A_{eo}{}^mC_{eo}T_{es}T_{es}T_e$ | 32 | 147 |
| 650487 | 2396 | 2413 | 44578 | 44595 | $T_{es}A_{eo}{}^mC_{eo}A_{eo}T_{es}{}^mC_{ds}T_{ds}{}^mC_{ds}A_{ds}A_{ds}T_{ds}T_{ds}A_{ds}A_{eo}A_{eo}G_{es}A_{es}G_e$ | 9 | 148 |
| 650488 | 2419 | 2436 | 44601 | 44618 | $T_{es}T_{eo}G_{eo}A_{eo}{}^mC_{es}{}^mC_{ds}{}^mC_{ds}A_{ds}G_{ds}{}^mC_{ds}A_{ds}A_{ds}G_{ds}A_{eo}A_{eo}A_{es}{}^mC_{es}T_e$ | 14 | 149 |
| 650489 | 2442 | 2459 | 44624 | 44641 | $T_{es}T_{eo}{}^mC_{eo}A_{eo}{}^mC_{es}{}^mC_{ds}A_{ds}A_{ds}A_{ds}A_{ds}T_{ds}G_{ds}A_{ds}T_{eo}A_{eo}{}^mC_{es}T_{es}A_e$ | 19 | 150 |
| 650490 | 2466 | 2483 | 44648 | 44665 | $A_{es}A_{eo}{}^mC_{eo}A_{eo}T_{es}{}^mC_{ds}A_{ds}A_{ds}T_{ds}T_{ds}T_{ds}{}^mC_{ds}A_{ds}G_{eo}A_{eo}G_{es}A_{es}{}^mC_e$ | 28 | 151 |
| 650491 | 2501 | 2518 | 44683 | 44700 | $G_{es}A_{eo}T_{eo}G_{eo}G_{es}A_{ds}G_{ds}A_{ds}A_{ds}T_{ds}G_{ds}A_{ds}G_{ds}G_{eo}G_{eo}A_{es}T_{es}A_e$ | 0 | 152 |
| 650492 | 2527 | 2544 | 44709 | 44726 | ${}^mC_{es}A_{eo}A_{eo}{}^mC_{eo}A_{es}T_{ds}T_{ds}{}^mC_{ds}A_{ds}A_{ds}A_{ds}A_{ds}G_{ds}A_{eo}G_{eo}{}^mC_{es}T_{es}T_e$ | 28 | 153 |
| 650493 | 2550 | 2567 | 44732 | 44749 | $T_{es}G_{eo}G_{eo}A_{eo}T_{es}T_{ds}T_{ds}T_{ds}T_{ds}A_{ds}G_{ds}{}^mC_{ds}T_{ds}T_{ds}A_{eo}T_{eo}G_{es}A_{es}A_e$ | 23 | 154 |
| 650494 | 2573 | 2590 | 44755 | 44772 | ${}^mC_{es}G_{eo}A_{eo}A_{eo}G_{es}T_{ds}T_{ds}G_{ds}T_{ds}{}^mC_{ds}A_{ds}G_{ds}{}^mC_{ds}T_{eo}G_{eo}A_{es}A_{es}A_e$ | 59 | 155 |
| 650495 | 2596 | 2613 | 44778 | 44795 | $G_{es}{}^mC_{eo}A_{eo}A_{eo}T_{es}A_{ds}T_{ds}A_{ds}{}^mC_{ds}{}^mC_{ds}A_{ds}T_{ds}A_{ds}T_{eo}T_{eo}A_{es}T_{es}A_e$ | 4 | 156 |
| 650496 | 2619 | 2636 | 44801 | 44818 | $G_{es}T_{eo}G_{eo}T_{eo}G_{es}{}^mC_{ds}A_{ds}G_{ds}{}^mC_{ds}{}^mC_{ds}{}^mC_{ds}A_{ds}{}^mC_{eo}A_{eo}{}^mC_{es}{}^mC_{es}A_e$ | 0 | 157 |
| 650497 | 2639 | 2656 | 44821 | 44838 | $A_{es}A_{eo}A_{eo}A_{eo}{}^mC_{es}T_{ds}T_{ds}T_{ds}{}^mC_{ds}{}^mC_{ds}{}^mC_{ds}T_{ds}Gi_{ds}A_{eo}T_{eo}A_{es}A_{es}A_e$ | 1 | 158 |
| 650498 | 2642 | 2659 | 44824 | 44841 | ${}^mC_{es}A_{eo}A_{eo}A_{eo}A_{es}A_{ds}A_{ds}{}^mC_{ds}T_{ds}T_{ds}T_{ds}{}^mC_{ds}{}^mC_{ds}{}^mC_{eo}T_{eo}G_{es}A_{es}T_e$ | 22 | 159 |
| 650499 | 2665 | 2682 | 44847 | 44864 | $T_{es}T_{eo}A_{eo}G_{eo}T_{es}T_{ds}A_{ds}G_{ds}{}^mC_{ds}A_{ds}A_{ds}T_{ds}A_{ds}A_{eo}A_{eo}T_{es}{}^mC_{es}{}^mC_e$ | 38 | 160 |
| 650500 | 2713 | 2730 | 44895 | 44912 | $A_{es}G_{eo}{}^mC_{eo}T_{eo}A_{es}T_{ds}T_{ds}T_{ds}T_{ds}A_{ds}T_{ds}A_{ds}A_{ds}T_{eo}{}^mC_{eo}A_{es}T_{es}A_e$ | 0 | 161 |
| 650501 | 2736 | 2753 | 44918 | 44935 | $A_{es}A_{eo}A_{eo}A_{eo}T_{es}{}^mC_{ds}T_{ds}G_{ds}T_{ds}T_{ds}A_{ds}T_{ds}A_{ds}T_{eo}{}^mC_{eo}G_{es}A_{es}A_e$ | 0 | 162 |
| 650502 | 2759 | 2776 | 44941 | 44958 | $A_{es}T_{eo}T_{eo}G_{eo}G_{es}{}^mC_{ds}A_{ds}{}^mC_{ds}A_{ds}A_{ds}A_{ds}A_{ds}T_{ds}A_{eo}A_{eo}T_{es}G_{es}A_e$ | 3 | 163 |
| 650503 | 2782 | 2799 | 44964 | 44981 | $G_{es}T_{eo}A_{eo}A_{eo}G_{es}G_{ds}G_{ds}A_{ds}A_{ds}A_{ds}{}^mC_{ds}T_{ds}I_{ds}{}^mC_{eo}A_{eo}G_{es}A_{es}A_e$ | 6 | 164 |
| 650504 | 2853 | 2870 | 45035 | 45052 | $T_{es}T_{eo}A_{eo}T_{eo}A_{es}A_{ds}T_{ds}T_{ds}{}^mC_{ds}T_{ds}T_{ds}{}^mC_{ds}T_{ds}G_{eo}A_{eo}A_{es}A_{es}{}^mC_e$ | 0 | 165 |
| 650505 | 2876 | 2893 | 45058 | 45075 | $A_{es}{}^mC_{eo}A_{eo}T_{eo}{}^mC_{es}{}^mC_{ds}{}^mC_{ds}T_{ds}T_{ds}G_{ds}{}^mC_{ds}A_{ds}G_{ds}T_{eo}T_{eo}T_{es}T_{es}A_e$ | 35 | 166 |
| 650506 | 2899 | 2916 | 45081 | 45098 | $T_{es}G_{eo}A_{eo}G_{eo}G_{es}G_{ds}A_{ds}A_{ds}T_{ds}A_{ds}G_{ds}T_{ds}A_{ds}{}^mC_{eo}T_{eo}A_{es}A_{es}A_e$ | 32 | 167 |
| 650507 | 2927 | 2944 | 45109 | 45126 | $G_{es}T_{eo}{}^mC_{eo}T_{eo}T_{es}A_{ds}A_{ds}A_{ds}A_{ds}T_{ds}A_{ds}T_{ds}T_{ds}T_{eo}A_{eo}G_{es}{}^mC_{es}T_e$ | 55 | 168 |
| 650508 | 2951 | 2968 | 45133 | 45150 | $G_{es}G_{eo}T_{eo}A_{eo}A_{es}T_{ds}A_{ds}A_{ds}T_{ds}T_{ds}A_{ds}A_{ds}{}^mC_{ds}A_{eo}T_{eo}A_{es}A_{es}A_e$ | 0 | 169 |
| 650509 | 2977 | 2994 | 45159 | 45176 | $T_{es}{}^mC_{eo}{}^mC_{eo}A_{eo}T_{es}G_{ds}G_{ds}A_{ds}A_{ds}A_{ds}A_{ds}T_{ds}A_{ds}T_{eo}G_{eo}A_{es}{}^mC_{es}A_e$ | 31 | 170 |
| 650510 | 3000 | 3017 | 45182 | 45199 | $T_{es}G_{eo}G_{eo}A_{eo}A_{es}A_{ds}A_{ds}G_{ds}G_{ds}T_{ds}A_{ds}A_{ds}T_{eo}G_{eo}A_{es}A_{es}{}^mC_e$ | 13 | 171 |
| 650511 | 3025 | 3042 | 45207 | 45224 | $T_{es}G_{eo}A_{eo}A_{eo}A_{es}A_{ds}G_{ds}T_{ds}T_{ds}T_{ds}A_{ds}A_{ds}T_{ds}G_{eo}T_{eo}A_{es}A_{es}{}^mC_e$ | 0 | 172 |
| 650512 | 3048 | 3065 | 45230 | 45247 | $G_{es}G_{eo}A_{eo}A_{eo}G_{es}{}^mC_{ds}T_{ds}{}^mC_{ds}A_{ds}T_{ds}{}^mC_{ds}A_{ds}A_{ds}T_{eo}T_{eo}{}^mC_{es}A_{es}A_e$ | 64 | 173 |
| 650513 | 3076 | 3093 | 45258 | 45275 | $G_{es}{}^mC_{eo}A_{eo}T_{eo}A_{es}T_{ds}T_{ds}G_{ds}G_{ds}T_{ds}T_{ds}T_{ds}T_{ds}{}^mC_{eo}T_{eo}{}^mC_{es}A_{es}T_e$ | 60 | 174 |
| 650514 | 3100 | 3117 | 45282 | 45299 | $A_{es}{}^mC_{eo}T_{eo}{}^mC_{eo}T_{es}A_{ds}A_{ds}A_{ds}G_{ds}T_{ds}I_{ds}A_{ds}A_{ds}A_{eo}{}^mC_{es}T_{es}T_e$ | 8 | 175 |
| 650515 | 3105 | 3122 | 45287 | 45304 | $T_{es}A_{eo}T_{eo}A_{eo}A_{es}A_{ds}{}^mC_{ds}T_{ds}{}^mC_{ds}T_{ds}A_{ds}A_{ds}A_{ds}G_{eo}T_{eo}T_{es}A_{es}A_e$ | 0 | 176 |
| 650516 | 3123 | 3140 | 45305 | 45322 | $T_{es}Ac_{o}G_{eo}G_{es}T_{ds}A_{ds}T_{ds}A_{ds}T_{ds}A_{ds}T_{ds}G_{ds}A_{eo}A_{eo}{}^mC_{es}T_{es}T_e$ | 5 | 177 |
| 650517 | 3146 | 3163 | 45328 | 45345 | ${}^mC_{es}A_{eo}T_{eo}A_{eo}T_{es}T_{ds}T_{ds}T_{ds}{}^mC_{ds}T_{ds}T_{ds}A_{ds}A_{ds}G_{eo}T_{eo}G_{es}{}^mC_{es}T_e$ | 35 | 178 |
| 650518 | 3169 | 3186 | 45351 | 45368 | $T_{es}A_{eo}G_{eo}G_{eo}A_{es}A_{ds}{}^mC_{ds}T_{ds}A_{ds}A_{ds}A_{ds}A_{ds}A_{ds}G_{ds}T_{eo}{}^mC_{eo}A_{es}A_{es}A_e$ | 21 | 179 |
| 650519 | 3391 | 3408 | 45573 | 45590 | ${}^mC_{es}{}^mC_{eo}A_{eo}A_{eo}A_{es}{}^mC_{ds}A_{ds}A_{ds}G_{ds}G_{ds}A_{ds}T_{ds}G_{ds}A_{ds}A_{eo}A_{eo}{}^mC_{es}{}^mC_{es}G_e$ | 28 | 180 |

TABLE 1-continued

Percent reduction of human ATXN3 mRNA by modified oligonucleotides relative to control

| IONIS No | SEQ ID No: 1 Start Site | SEQ ID No: 1 Stop Site | SEQ ID No: 2 Start Site | SEQ ID No: 2 Stop Site | Sequence (5' to 3') | % Inhib. | SEQ ID No |
|---|---|---|---|---|---|---|---|
| 650520 | 3491 | 3508 | 45673 | 45690 | $T_{es}{}^mC_{eo}T_{eo}A_{eo}G_{es}{}^mC_{ds}T_{ds}G_{ds}G_{ds}{}^mC_{ds}{}^mC_{ds}A_{ds}G_{ds}G_{eo}{}^mC_{eo}G_{es}{}^mC_{es}A_e$ | 0 | 181 |
| 650521 | 3514 | 3531 | 45696 | 45713 | $G_{es}{}^mC_{eo}T_{eo}{}^mC_{eo}A_{es}G_{ds}{}^mC_{ds}T_{ds}{}^mC_{ds}T_{ds}G_{ds}{}^mC_{ds}T_{ds}T_{eo}T_{eo}A_{es}A_{es}A_e$ | 43 | 182 |
| 650522 | 3537 | 3554 | 45719 | 45736 | $A_{es}{}^mC_{eo}A_{eo}T_{eo}T_{es}{}^mC_{ds}A_{ds}A_{ds}A_{ds}{}^mC_{ds}G_{ds}{}^mC_{ds}A_{ds}T_{eo}{}^mC_{eo}{}^mC_{es}A_{es}G_e$ | 41 | 183 |
| 650523 | 3560 | 3577 | 45742 | 45759 | $A_{es}T_{eo}T_{eo}T_{eo}{}^mC_{es}A_{ds}{}^mC_{ds}A_{ds}A_{ds}{}^mC_{ds}A_{ds}A_{ds}A_{ds}{}^mC_{eo}T_{eo}A_{es}{}^mC_{es}A_e$ | 26 | 184 |
| 650524 | 3583 | 3600 | 45765 | 45782 | $G_{es}G_{eo}A_{eo}T_{eo}{}^mC_{es}T_{ds}G_{ds}{}^mC_{ds}{}^mC_{ds}T_{ds}G_{ds}{}^mC_{ds}T_{ds}A_{eo}A_{eo}A_{es}T_{es}G_e$ | 18 | 185 |
| 650525 | 3606 | 3623 | 45788 | 45805 | $G_{es}A_{eo}G_{eo}G_{eo}A_{es}{}^mC_{ds}A_{ds}G_{ds}T_{ds}I_{ds}{}^mC_{ds}A_{ds}{}^mC_{ds}T_{eo}A_{eo}G_{es}T_{es}G_e$ | 17 | 186 |
| 650526 | 3629 | 3646 | 45811 | 45828 | $T_{es}A_{eo}A_{eo}A_{eo}T_{es}T_{ds}T_{ds}A_{ds}A_{ds}G_{ds}{}^mC_{ds}{}^mC_{ds}A_{ds}A_{eo}{}^mC_{eo}{}^mC_{es}{}^mC_{es}{}^mC_e$ | 17 | 187 |
| 650527 | 3659 | 3676 | 45841 | 45858 | ${}^mC_{es}A_{eo}A_{eo}T_{eo}T_{es}A_{ds}A_{ds}G_{ds}A_{ds}A_{ds}A_{ds}T_{ds}G_{ds}G_{eo}A_{eo}A_{es}T_{es}{}^mC_e$ | 9 | 188 |
| 650528 | 3681 | 3698 | 45863 | 45880 | $G_{es}{}^mC_{eo}A_{eo}T_{eo}{}^mC_{es}T_{ds}T_{ds}T_{ds}T_{ds}{}^mC_{ds}A_{ds}T_{ds}A_{ds}{}^mC_{eo}T_{eo}G_{es}G_{es}{}^mC_e$ | 63 | 189 |
| 650529 | 3684 | 3701 | 45866 | 45883 | ${}^mC_{es}T_{eo}G_{eo}G_{eo}{}^mC_{es}A_{ds}T_{ds}{}^mC_{ds}T_{ds}T_{ds}T_{ds}T_{ds}{}^mC_{ds}A_{eo}T_{eo}A_{es}{}^mC_{es}T_e$ | 33 | 190 |
| 650530 | 3707 | 3724 | 45889 | 45906 | $T_{es}T_{eo}T_{eo}T_{eo}G_{es}A_{ds}I_{ds}A_{ds}{}^mC_{ds}T_{ds}A_{ds}T_{ds}G_{ds}G_{eo}T_{eo}T_{es}A_{es}{}^mC_e$ | 33 | 191 |
| 650531 | 3731 | 3748 | 45913 | 45930 | $A_{es}T_{eo}A_{eo}G_{eo}{}^mC_{es}T_{ds}T_{ds}T_{ds}G_{ds}A_{ds}A_{ds}T_{ds}A_{ds}A_{eo}T_{eo}T_{es}T_{es}T_e$ | 7 | 192 |
| 650532 | 3754 | 3771 | 45936 | 45953 | $T_{es}G_{eo}G_{eo}{}^mC_{eo}A_{es}G_{ds}T_{ds}A_{ds}{}^mC_{ds}{}^mC_{ds}T_{ds}G_{ds}A_{ds}T_{eo}G_{eo}T_{es}A_{es}T_e$ | 50 | 193 |
| 650533 | 3777 | 3794 | 45959 | 45976 | $T_{es}{}^mC_{eo}T_{eo}T_{eo}G_{es}{}^mC_{ds}A_{ds}G_{ds}G_{ds}T_{ds}G_{ds}G_{ds}T_{ds}T_{eo}T_{eo}A_{es}{}^mC_{es}A_e$ | 24 | 194 |
| 650534 | 3800 | 3817 | 45982 | 45999 | $G_{es}T_{eo}G_{eo}A_{eo}A_{es}T_{ds}T_{ds}T_{ds}A_{ds}G_{ds}T_{ds}T_{ds}G_{ds}T_{eo}T_{eo}{}^mC_{es}{}^mC_{es}T_e$ | 42 | 195 |
| 650535 | 3823 | 3840 | 46005 | 46022 | ${}^mC_{es}A_{eo}{}^mC_{eo}T_{eo}T_{es}{}^mC_{ds}T_{ds}T_{ds}A_{ds}G_{ds}{}^mC_{ds}A_{ds}G_{ds}G_{eo}A_{eo}{}^mC_{es}A_{es}G_e$ | 0 | 196 |
| 650536 | 3859 | 3876 | 46041 | 46058 | $T_{es}T_{eo}{}^mC_{eo}{}^mC_{eo}{}^mC_{es}A_{ds}A_{ds}T_{ds}T_{ds}A_{ds}G_{ds}T_{ds}A_{ds}A_{eo}A_{eo}A_{es}{}^mC_{es}A_e$ | 0 | 197 |
| 650537 | 3889 | 3906 | 46071 | 46088 | ${}^mC_{es}{}^mC_{eo}A_{eo}A_{eo}T_{es}A_{ds}G_{ds}T_{ds}T_{ds}T_{ds}A_{ds}A_{ds}A_{ds}T_{eo}A_{eo}T_{es}T_{es}A_e$ | 0 | 198 |
| 650538 | 3916 | 3933 | 46098 | 46115 | $T_{es}A_{eo}{}^mC_{eo}A_{eo}A_{es}A_{ds}T_{ds}T_{ds}A_{ds}T_{ds}A_{ds}{}^mC_{ds}A_{ds}T_{eo}T_{eo}A_{eo}G_{es}A_e$ | 0 | 199 |
| 650539 | 3939 | 3956 | 46121 | 46138 | ${}^mC_{es}T_{eo}G_{eo}T_{eo}A_{es}{}^mC_{ds}A_{ds}T_{ds}A_{ds}{}^mC_{ds}T_{ds}T_{ds}G_{ds}A_{eo}T_{eo}{}^mC_{es}{}^mC_{es}{}^mC_e$ | 32 | 200 |
| 650540 | 3962 | 3979 | 46144 | 46161 | $T_{es}T_{eo}A_{eo}A_{eo}A_{es}{}^mC_{ds}T_{ds}T_{ds}T_{ds}{}^mC_{ds}T_{ds}A_{ds}{}^mC_{ds}T_{ds}A_{eo}G_{eo}{}^mC_{es}A_{es}T_e$ | 0 | 201 |
| 650541 | 3985 | 4002 | 46167 | 46184 | $T_{es}A_{eo}T_{eo}G_{eo}A_{es}A_{ds}A_{ds}G_{ds}T_{ds}G_{ds}G_{ds}T_{ds}A_{ds}T_{eo}T_{eo}T_{es}{}^mC_{es}{}^mC_e$ | 26 | 202 |
| 650542 | 4008 | 4025 | 46190 | 46207 | $A_{es}T_{eo}T_{eo}A_{eo}A_{es}A_{ds}T_{ds}{}^mC_{ds}{}^mC_{ds}A_{ds}T_{ds}G_{ds}A_{ds}{}^mC_{eo}A_{eo}T_{es}{}^mC_{es}T_e$ | 31 | 203 |
| 650543 | 4045 | 4062 | 46227 | 46244 | $G_{es}A_{eo}T_{eo}T_{eo}A_{es}A_{ds}{}^mC_{ds}A_{ds}A_{ds}T_{ds}T_{ds}{}^mC_{ds}A_{ds}G_{eo}A_{eo}A_{es}T_{es}T_e$ | 28 | 204 |
| 650544 | 4068 | 4085 | 46250 | 46267 | $T_{es}A_{eo}G_{eo}A_{eo}T_{es}T_{ds}G_{ds}A_{ds}T_{ds}G_{ds}G_{ds}T_{ds}T_{ds}T_{eo}T_{eo}A_{es}G_{es}A_e$ | 23 | 205 |
| 650545 | 4091 | 4108 | 46273 | 46290 | $T_{es}T_{eo}A_{eo}{}^mC_{eo}A_{es}T_{ds}G_{ds}A_{ds}T_{ds}T_{ds}A_{ds}{}^mC_{ds}{}^mC_{ds}G_{eo}T_{eo}A_{es}A_{es}A_e$ | 26 | 206 |
| 650546 | 4114 | 4131 | 46296 | 46313 | $A_{es}A_{eo}{}^mC_{eo}A_{eo}G_{es}T_{ds}T_{ds}T_{ds}A_{ds}T_{ds}A_{ds}T_{ds}T_{ds}A_{eo}{}^mC_{eo}T_{es}G_{es}A_e$ | 10 | 207 |
| 650547 | 4137 | 4154 | 46319 | 46336 | $G_{es}T_{eo}T_{eo}T_{eo}A_{es}{}^mC_{ds}{}^mC_{ds}T_{ds}G_{ds}{}^mC_{ds}A_{ds}G_{ds}{}^mC_{ds}A_{eo}G_{eo}{}^mC_{es}{}^mC_{es}T_e$ | 12 | 208 |
| 650548 | 4160 | 4177 | 46342 | 46359 | $T_{es}T_{eo}T_{eo}G_{eo}G_{es}{}^mC_{ds}{}^mC_{ds}A_{ds}A_{ds}A_{ds}G_{ds}A_{ds}T_{ds}{}^mC_{ds}{}^mC_{eo}T_{eo}A_{es}G_{es}T_e$ | 19 | 209 |
| 650549 | 4183 | 4200 | 46365 | 46382 | $A_{es}A_{eo}T_{eo}A_{eo}T_{es}T_{ds}{}^mC_{ds}T_{ds}G_{ds}T_{ds}G_{ds}A_{ds}A_{ds}A_{ds}T_{eo}T_{eo}G_{es}T_{es}A_e$ | 23 | 210 |
| 650550 | 4206 | 4223 | 46388 | 46405 | $A_{es}A_{eo}A_{eo}A_{eo}A_{es}A_{ds}A_{ds}G_{ds}{}^mC_{ds}A_{ds}{}^mC_{ds}{}^mC_{ds}A_{ds}{}^mC_{eo}{}^mC_{eo}T_{es}T_{es}A_e$ | 12 | 211 |
| 650551 | 4247 | 4264 | 46429 | 46446 | $T_{es}{}^mC_{eo}A_{eo}T_{eo}G_{es}A_{ds}A_{ds}T_{ds}A_{ds}A_{ds}A_{ds}G_{ds}T_{ds}T_{eo}A_{eo}A_{es}G_{es}A_e$ | 34 | 212 |
| 650552 | 4272 | 4289 | 46454 | 46471 | $G_{es}T_{eo}T_{eo}T_{eo}T_{es}T_{ds}T_{ds}T_{ds}{}^mC_{ds}{}^mC_{ds}T_{ds}{}^mC_{ds}A_{ds}T_{eo}T_{eo}T_{es}A_{es}{}^mC_e$ | 10 | 213 |
| 650553 | 4295 | 4312 | 46477 | 46494 | ${}^mC_{es}A_{eo}A_{eo}T_{eo}G_{es}A_{ds}T_{ds}A_{ds}{}^mC_{ds}T_{ds}{}^mC_{ds}A_{ds}A_{ds}{}^mC_{eo}T_{eo}G_{es}G_{es}T_e$ | 34 | 214 |
| 650554 | 4318 | 4335 | 46500 | 46517 | $T_{es}G_{eo}G_{eo}A_{eo}{}^mC_{es}T_{ds}A_{ds}{}^mC_{ds}T_{ds}G_{ds}G_{ds}T_{ds}A_{ds}G_{eo}T_{eo}T_{es}T_{es}T_e$ | 44 | 215 |
| 650555 | 4365 | 4382 | 46547 | 46564 | $T_{es}{}^mC_{eo}T_{eo}G_{eo}A_{es}{}^mC_{ds}T_{ds}G_{ds}A_{ds}A_{ds}A_{ds}T_{ds}A_{ds}A_{eo}A_{eo}A_{es}T_{es}T_e$ | 10 | 216 |

TABLE 1-continued

Percent reduction of human ATXN3 mRNA by modified oligonucleotides relative to control

| IONIS No | SEQ ID No: 1 Start Site | SEQ ID No: 1 Stop Site | SEQ ID No: 2 Start Site | SEQ ID No: 2 Stop Site | Sequence (5' to 3') | % Inhib. | SEQ ID No |
|---|---|---|---|---|---|---|---|
| 650556 | 4388 | 4405 | 46570 | 46587 | $G_{es}A_{eo}{}^mC_{eo}A_{eo}A_{es}T_{ds}{}^mC_{ds}A_{ds}A_{ds}A_{ds}A_{ds}T_{ds}G_{ds}T_{eo}G_{eo}A_{es}T_{es}T_e$ | 12 | 217 |
| 650557 | 4424 | 4441 | 46606 | 46623 | ${}^mC_{es}A_{eo}{}^mC_{eo}T_{eo}A_{es}G_{ds}{}^mC_{ds}A_{ds}T_{ds}G_{ds}A_{ds}T_{ds}T_{ds}T_{eo}T_{eo}A_{es}A_{es}A_e$ | 9 | 218 |
| 650558 | 4645 | 4662 | 46827 | 46844 | $T_{es}{}^mC_{eo}{}^mC_{eo}T_{eo}{}^mC_{es}T_{ds}G_{ds}T_{ds}{}^mC_{ds}G_{ds}{}^mC_{ds}{}^mC_{ds}A_{ds}G_{eo}G_{eo}G_{es}T_{es}T_e$ | 29 | 219 |
| 650559 | 4734 | 4751 | 46916 | 46933 | ${}^mC_{es}A_{eo}{}^mC_{eo}T_{eo}A_{es}G_{ds}{}^mC_{ds}A_{ds}T_{ds}G_{ds}A_{ds}T_{ds}T_{ds}T_{eo}T_{eo}T_{es}T_{es}T_e$ | 0 | 220 |
| 650560 | 4758 | 4775 | 46940 | 46957 | $T_{es}T_{eo}T_{eo}T_{eo}A_{es}A_{ds}G_{ds}A_{ds}A_{ds}T_{ds}T_{ds}T_{ds}A_{ds}G_{eo}T_{eo}A_{es}G_{es}{}^mC_e$ | 8 | 221 |
| 650561 | 4781 | 4798 | 46963 | 46980 | $T_{es}{}^mC_{eo}T_{eo}G_{eo}T_{es}A_{ds}{}^mC_{ds}A_{ds}G_{ds}G_{ds}G_{ds}T_{ds}{}^mC_{ds}{}^mC_{ds}A_{eo}A_{eo}T_{es}G_{es}G_e$ | 6 | 222 |
| 650562 | 4804 | 4821 | 46986 | 47003 | $T_{es}T_{eo}A_{eo}T_{eo}G_{es}{}^mC_{ds}A_{ds}{}^mC_{ds}T_{ds}G_{ds}A_{ds}A_{ds}T_{ds}{}^mC_{eo}T_{eo}A_{es}T_{es}T_e$ | 16 | 223 |
| 650563 | 4868 | 4885 | 47050 | 47067 | ${}^mC_{es}G_{eo}T_{eo}A_{eo}A_{es}G_{ds}A_{ds}A_{ds}A_{ds}T_{ds}T_{ds}T_{ds}A_{ds}A_{ds}A_{eo}A_{eo}{}^mC_{es}A_{es}T_e$ | 0 | 224 |
| 650564 | 4892 | 4909 | 47074 | 47091 | ${}^mC_{es}A_{eo}T_{eo}{}^mC_{eo}A_{es}A_{ds}T_{ds}A_{ds}T_{ds}T_{ds}A_{ds}A_{ds}{}^mC_{ds}T_{eo}A_{eo}T_{es}G_{es}G_e$ | 0 | 225 |
| 650565 | 5092 | 5109 | 47274 | 47291 | $T_{es}G_{eo}{}^mC_{eo}G_{eo}A_{es}T_{ds}T_{ds}{}^mC_{ds}T_{ds}T_{ds}A_{ds}G_{ds}{}^mC_{ds}{}^mC_{eo}T_{eo}{}^mC_{es}{}^mC_{es}T_e$ | 45 | 226 |
| 650566 | 5128 | 5145 | 47310 | 47327 | ${}^mC_{es}{}^mC_{eo}{}^mC_{eo}T_{eo}T_{es}G_{ds}G_{ds}{}^mC_{ds}A_{ds}{}^mC_{ds}T_{ds}{}^mC_{ds}T_{ds}G_{eo}{}^mC_{eo}A_{es}A_{es}{}^mC_e$ | 14 | 227 |
| 650567 | 5167 | 5184 | 47349 | 47366 | $T_{es}G_{eo}T_{eo}{}^mC_{eo}T_{es}{}^mC_{ds}A_{ds}{}^mC_{ds}A_{ds}{}^mC_{ds}T_{ds}G_{ds}T_{ds}T_{eo}G_{eo}G_{es}G_{es}{}^mC_e$ | 34 | 228 |
| 650568 | 5245 | 5262 | 47427 | 47444 | $T_{es}A_{eo}G_{eo}G_{eo}A_{es}A_{ds}G_{ds}T_{ds}{}^mC_{ds}A_{ds}T_{ds}A_{ds}T_{ds}A_{eo}T_{eo}A_{es}T_{es}A_e$ | 0 | 229 |
| 650569 | 5268 | 5285 | 47450 | 47467 | ${}^mC_{es}{}^mC_{eo}{}^mC_{eo}G_{eo}A_{es}{}^mC_{ds}T_{ds}G_{ds}G_{ds}G_{ds}A_{ds}T_{ds}A_{ds}A_{eo}A_{eo}G_{es}T_{es}T_e$ | 1 | 230 |
| 650570 | 5406 | 5423 | 47588 | 47605 | $T_{es}A_{eo}{}^mC_{eo}{}^mC_{eo}T_{es}G_{ds}{}^mC_{ds}T_{ds}T_{ds}A_{ds}A_{ds}G_{ds}T_{eo}T_{eo}T_{es}T_{es}G_e$ | 15 | 231 |
| 650571 | 5551 | 5568 | 47733 | 47750 | $A_{es}{}^mC_{eo}{}^mC_{eo}T_{eo}T_{es}T_{ds}A_{ds}A_{ds}G_{ds}A_{ds}T_{ds}G_{ds}G_{ds}A_{eo}G_{eo}T_{es}T_{es}T_e$ | 49 | 232 |
| 650572 | 5575 | 5592 | 47757 | 47774 | $T_{es}{}^mC_{eo}{}^mC_{eo}G_{eo}G_{es}A_{ds}T_{ds}A_{ds}A_{ds}A_{ds}A_{ds}A_{ds}A_{eo}A_{eo}A_{es}A_{es}{}^mC_e$ | 0 | 233 |
| 650573 | 5602 | 5619 | 47784 | 47801 | $A_{es}A_{eo}A_{eo}A_{eo}T_{es}A_{ds}G_{ds}{}^mC_{ds}G_{ds}G_{ds}{}^mC_{ds}{}^mC_{ds}A_{ds}A_{eo}A_{eo}{}^mC_{es}G_{es}{}^mC_e$ | 11 | 234 |
| 650574 | 5797 | 5814 | 47979 | 47996 | $A_{es}A_{eo}{}^mC_{eo}A_{eo}A_{es}T_{ds}A_{ds}T_{ds}T_{ds}{}^mC_{ds}G_{ds}{}^mC_{ds}{}^mC_{eo}A_{eo}G_{es}G_{es}T_e$ | 8 | 235 |
| 650575 | 5927 | 5944 | 48109 | 48126 | $T_{es}G_{eo}G_{eo}{}^mC_{eo}{}^mC_{es}{}^mC_{ds}A_{ds}A_{ds}A_{ds}G_{ds}G_{ds}{}^mC_{ds}{}^mC_{ds}G_{ds}G_{eo}G_{eo}T_{es}G_{es}T_e$ | 7 | 236 |
| 650576 | 5953 | 5970 | 48135 | 48152 | ${}^mC_{es}A_{eo}A_{eo}{}^mC_{eo}A_{es}A_{ds}A_{ds}{}^mC_{ds}A_{ds}A_{ds}T_{ds}T_{ds}{}^mC_{ds}A_{eo}{}^mC_{eo}T_{es}T_{es}T_e$ | 8 | 237 |
| 650577 | 5976 | 5993 | 48158 | 48175 | $T_{es}A_{eo}T_{eo}{}^mC_{eo}{}^mC_{es}A_{ds}T_{ds}A_{ds}{}^mC_{ds}T_{ds}T_{ds}A_{ds}A_{ds}G_{eo}G_{eo}A_{es}{}^mC_{es}T_e$ | 8 | 238 |
| 650578 | 5999 | 6016 | 48181 | 48198 | $G_{es}T_{eo}T_{eo}{}^mC_{eo}T_{es}T_{ds}A_{ds}A_{ds}T_{ds}T_{ds}A_{ds}G_{ds}G_{ds}G_{eo}T_{eo}{}^mC_{es}A_{es}{}^mC_e$ | 57 | 239 |
| 650579 | 6022 | 6039 | 48204 | 48221 | $T_{es}G_{eo}A_{eo}T_{eo}T_{es}A_{ds}G_{ds}T_{ds}T_{ds}G_{ds}A_{ds}T_{ds}{}^mC_{ds}{}^mC_{eo}A_{eo}A_{es}T_{es}{}^mC_e$ | 32 | 240 |
| 650580 | 6045 | 6062 | 48227 | 48244 | $T_{es}A_{eo}A_{eo}A_{eo}G_{es}T_{ds}T_{ds}A_{ds}T_{ds}T_{ds}T_{ds}A_{ds}{}^mC_{ds}A_{eo}T_{eo}T_{es}G_{es}{}^mC_e$ | 0 | 241 |
| 650581 | 6103 | 6120 | 48285 | 48302 | $G_{es}A_{eo}T_{eo}G_{eo}{}^mC_{es}T_{ds}G_{ds}G_{ds}T_{ds}T_{ds}A_{ds}T_{ds}A_{ds}A_{eo}A_{eo}G_{es}G_{es}G_e$ | 0 | 242 |
| 650582 | 6128 | 6145 | 48310 | 48327 | $G_{es}{}^mC_{eo}{}^mC_{eo}A_{eo}G_{es}G_{ds}T_{ds}{}^mC_{ds}A_{ds}T_{ds}T_{ds}T_{ds}T_{ds}T_{eo}T_{eo}A_{es}A_{es}A_e$ | 20 | 243 |
| 650583 | 6158 | 6175 | 48340 | 48357 | $T_{es}T_{eo}A_{eo}T_{eo}T_{es}A_{ds}T_{ds}G_{ds}T_{ds}T_{ds}T_{ds}A_{ds}A_{ds}G_{eo}A_{eo}{}^mC_{es}T_{es}A_e$ | 35 | 244 |
| 650584 | 6188 | 6205 | 48370 | 48387 | $T_{es}{}^mC_{eo}A_{eo}T_{eo}G_{es}A_{ds}A_{ds}A_{ds}G_{ds}{}^mC_{ds}A_{ds}A_{ds}A_{ds}T_{eo}T_{eo}A_{es}G_{es}A_e$ | 0 | 245 |
| 650585 | 6211 | 6228 | 48393 | 48410 | ${}^mC_{es}{}^mC_{eo}A_{eo}A_{eo}{}^mC_{es}G_{ds}A_{ds}T_{ds}G_{ds}I_{ds}{}^mC_{ds}A_{ds}A_{ds}T_{eo}A_{eo}A_{es}T_{es}{}^mC_e$ | 30 | 246 |
| 650586 | 6285 | 6302 | 48467 | 48484 | $A_{es}G_{eo}A_{eo}{}^mC_{eo}{}^mC_{es}A_{ds}{}^mC_{ds}T_{ds}T_{ds}G_{ds}G_{ds}A_{ds}A_{ds}A_{eo}A_{eo}A_{es}A_{es}T_e$ | 13 | 247 |
| 650587 | 6308 | 6325 | 48490 | 48507 | $T_{es}T_{eo}A_{eo}G_{eo}{}^mC_{es}A_{ds}{}^mC_{ds}T_{ds}A_{ds}A_{ds}T_{ds}T_{ds}{}^mC_{ds}T_{eo}T_{eo}A_{es}A_{es}A_e$ | 17 | 248 |
| 650588 | 6331 | 6348 | 48513 | 48530 | ${}^mC_{es}G_{eo}A_{eo}{}^mC_{eo}A_{es}A_{ds}A_{ds}T_{ds}T_{ds}T_{ds}G_{ds}A_{ds}A_{eo}G_{eo}T_{es}T_{es}A_e$ | 0 | 249 |
| 650589 | 6354 | 6371 | 48536 | 48553 | $T_{es}A_{eo}T_{eo}G_{eo}{}^mC_{es}T_{ds}A_{ds}T_{ds}T_{ds}A_{ds}A_{ds}A_{ds}{}^mC_{ds}A_{eo}T_{eo}G_{es}{}^mC_{es}{}^mC_e$ | 11 | 250 |
| 650590 | 6378 | 6395 | 48560 | 48577 | ${}^mC_{es}{}^mC_{eo}A_{eo}{}^mC_{eo}A_{es}G_{ds}G_{ds}{}^mC_{ds}T_{ds}T_{ds}A_{ds}A_{ds}A_{ds}A_{eo}T_{eo}G_{es}T_{es}T_e$ | 24 | 251 |
| 650591 | 6401 | 6418 | 48583 | 48600 | $T_{es}T_{eo}{}^mC_{eo}T_{eo}{}^mC_{es}A_{ds}T_{ds}T_{ds}G_{ds}{}^mC_{ds}T_{ds}T_{ds}T_{ds}G_{eo}T_{eo}{}^mC_{es}T_{es}A_e$ | 15 | 252 |
| 650592 | 6430 | 6447 | 48612 | 48629 | $A_{es}G_{eo}G_{eo}A_{eo}A_{es}T_{ds}A_{ds}A_{ds}T_{ds}{}^mC_{ds}{}^mC_{ds}A_{ds}T_{ds}T_{ds}T_{eo}A_{eo}T_{es}A_{es}T_e$ | 4 | 253 |

TABLE 1-continued

Percent reduction of human ATXN3 mRNA by modified oligonucleotides relative to control

| IONIS No | SEQ ID No: 1 Start Site | SEQ ID No: 1 Stop Site | SEQ ID No: 2 Start Site | SEQ ID No: 2 Stop Site | Sequence (5' to 3') | % Inhib. | SEQ ID No |
|---|---|---|---|---|---|---|---|
| 650593 | 6453 | 6470 | 48635 | 48652 | $A_{es}T_{eo}T_{eo}G_{es}A_{es}G_{ds}A_{ds}A_{ds}{}^mC_{ds}T_{ds}T_{ds}{}^mC_{ds}{}^mC_{ds}T_{eo}A_{eo}A_{es}A_{es}T_{e}$ | 33 | 254 |
| 650594 | 6476 | 6493 | 48658 | 48675 | $T_{es}T_{eo}{}^mC_{eo}{}^mC_{es}T_{ds}G_{ds}A_{ds}A_{ds}{}^mC_{ds}T_{ds}A_{ds}T_{ds}G_{eo}{}^mC_{eo}A_{es}A_{es}G_{e}$ | 9 | 255 |
| 650595 | 6552 | 6569 | 48734 | 48751 | $A_{es}T_{eo}T_{eo}A_{eo}G_{es}A_{ds}T_{ds}A_{ds}A_{ds}T_{ds}{}^mC_{ds}A_{ds}{}^mC_{ds}A_{eo}T_{eo}T_{es}T_{es}A_{e}$ | 29 | 256 |
| 650596 | 6575 | 6592 | 48757 | 48774 | ${}^mC_{es}{}^mC_{eo}T_{eo}A_{eo}A_{es}T_{ds}A_{ds}G_{ds}{}^mC_{ds}{}^mC_{ds}{}^mC_{ds}A_{ds}A_{ds}G_{ds}T_{eo}G_{eo}T_{es}T_{es}G_{e}$ | 16 | 257 |
| 650597 | 6606 | 6623 | 48788 | 48805 | $T_{es}A_{eo}T_{eo}A_{eo}{}^mC_{es}A_{ds}G_{ds}A_{ds}A_{ds}{}^mC_{ds}A_{ds}G_{ds}T_{ds}A_{ds}T_{eo}A_{eo}T_{es}T_{es}T_{e}$ | 0 | 258 |
| 650598 | 6629 | 6646 | 48811 | 48828 | $T_{es}{}^mC_{eo}T_{eo}G_{eo}T_{es}A_{ds}{}^mC_{ds}T_{ds}T_{ds}G_{ds}A_{ds}A_{ds}A_{ds}T_{ds}T_{eo}T_{eo}{}^mC_{es}A_{es}A_{e}$ | 43 | 259 |
| 650599 | 6659 | 6676 | 48841 | 48858 | $A_{es}A_{eo}A_{eo}{}^mC_{eo}A_{es}A_{ds}{}^mC_{ds}A_{ds}A_{ds}T_{ds}G_{ds}{}^mC_{ds}T_{ds}T_{eo}T_{eo}T_{es}T_{es}G_{e}$ | 0 | 260 |
| 650600 | 6682 | 6699 | 48864 | 48881 | ${}^mC_{es}A_{eo}{}^mC_{eo}A_{eo}G_{es}T_{ds}G_{ds}{}^mC_{ds}A_{ds}{}^mC_{ds}T_{ds}T_{ds}G_{ds}T_{eo}A_{eo}T_{es}{}^mC_{es}A_{e}$ | 0 | 261 |
| 650601 | 6705 | 6722 | 48887 | 48904 | $G_{es}G_{eo}G_{eo}T_{eo}{}^mC_{es}{}^mC_{ds}T_{ds}G_{ds}A_{ds}A_{ds}G_{ds}{}^mC_{ds}A_{ds}A_{ds}G_{eo}{}^mC_{eo}G_{es}G_{es}{}^mC_{e}$ | 2 | 262 |
| 650602 | 6728 | 6745 | 48910 | 48927 | $A_{es}{}^mC_{eo}A_{eo}{}^mC_{eo}A_{es}{}^mC_{ds}A_{ds}G_{ds}A_{ds}A_{ds}G_{ds}G_{ds}G_{ds}G_{ds}{}^mC_{eo}T_{eo}G_{es}{}^mC_{es}A_{e}$ | 16 | 263 |
| 650603 | 6751 | 6768 | 48933 | 48950 | $G_{es}{}^mC_{eo}A_{eo}A_{eo}A_{es}T_{ds}G_{ds}A_{ds}A_{ds}{}^mC_{ds}T_{ds}T_{ds}A_{ds}A_{eo}{}^mC_{eo}G_{es}A_{es}G_{e}$ | 27 | 264 |
| 650604 | 6774 | 6791 | 48956 | 48973 | $G_{es}A_{eo}A_{eo}G_{eo}G_{es}{}^mC_{ds}{}^mC_{ds}T_{ds}G_{ds}T_{ds}G_{ds}T_{ds}G_{ds}T_{eo}G_{eo}T_{es}A_{es}A_{e}$ | 6 | 265 |
| 650605 | 6797 | 6814 | 48979 | 48996 | ${}^mC_{es}G_{eo}G_{eo}{}^mC_{eo}T_{es}T_{ds}T_{ds}T_{ds}{}^mC_{ds}T_{ds}A_{ds}A_{ds}{}^mC_{ds}G_{eo}A_{eo}{}^mC_{es}{}^mC_{es}A_{e}$ | 27 | 266 |
| 650606 | 6808 | 6825 | 48990 | 49007 | ${}^mC_{es}T_{eo}T_{eo}T_{eo}G_{es}A_{ds}A_{ds}A_{ds}G_{ds}{}^mC_{ds}{}^mC_{ds}{}^mC_{ds}G_{ds}G_{ds}{}^mC_{eo}T_{es}T_{es}T_{e}$ | 15 | 267 |
| 650607 | 6820 | 6837 | 49002 | 49019 | $T_{es}G_{eo}T_{eo}T_{eo}{}^mC_{es}A_{ds}A_{ds}{}^mC_{ds}A_{ds}G_{ds}T_{ds}G_{ds}{}^mC_{ds}T_{eo}T_{eo}T_{es}G_{es}G_{e}$ | 0 | 268 |
| 650608 | 6843 | 6860 | 49025 | 49042 | $T_{es}{}^mC_{eo}{}^mC_{eo}A_{eo}{}^mC_{es}A_{ds}{}^mC_{ds}T_{ds}A_{ds}A_{ds}{}^mC_{ds}A_{ds}A_{ds}{}^mC_{eo}A_{eo}G_{es}A_{es}A_{e}$ | 25 | 269 |
| 650609 | 6880 | 6897 | 49062 | 49079 | $A_{es}A_{eo}A_{eo}A_{eo}A_{es}T_{ds}{}^mC_{ds}T_{ds}T_{ds}T_{ds}G_{ds}A_{ds}T_{ds}A_{eo}T_{eo}T_{es}T_{es}A_{e}$ | 0 | 270 |
| 650612 | N/A | N/A | 13822 | 13839 | $G_{es}{}^mC_{eo}A_{eo}T_{eo}T_{es}G_{ds}{}^mC_{ds}T_{ds}T_{ds}A_{ds}T_{ds}A_{ds}A_{ds}{}^mC_{eo}{}^mC_{eo}T_{es}G_{es}T_{e}$ | 50 | 271 |
| 650616 | N/A | N/A | 26677 | 26694 | $A_{es}{}^mC_{eo}T_{eo}T_{eo}T_{es}{}^mC_{ds}A_{ds}A_{ds}A_{ds}G_{ds}T_{ds}A_{ds}A_{eo}G_{eo}{}^mC_{es}T_{es}T_{e}$ | 4 | 272 |
| 650617 | N/A | N/A | 26686 | 26703 | $A_{es}A_{eo}{}^mC_{eo}T_{eo}A_{es}{}^mC_{ds}T_{ds}T_{ds}T_{ds}A_{ds}{}^mC_{ds}T_{ds}T_{ds}T_{eo}T_{eo}{}^mC_{es}A_{es}A_{e}$ | 0 | 273 |
| 650625 | N/A | N/A | 24160 | 24177 | $T_{es}G_{eo}A_{eo}A_{es}A_{es}G_{ds}A_{ds}G_{ds}{}^mC_{ds}{}^mC_{ds}G_{ds}T_{ds}{}^mC_{ds}T_{eo}{}^mC_{eo}A_{es}T_{es}T_{e}$ | 15 | 274 |
| 650626 | N/A | N/A | 24210 | 24227 | $T_{es}A_{eo}A_{eo}G_{eo}G_{es}T_{ds}A_{ds}A_{ds}G_{ds}T_{ds}T_{ds}A_{ds}{}^mC_{ds}T_{eo}A_{eo}A_{es}A_{es}A_{e}$ | 0 | 275 |
| 650629 | N/A | N/A | 24515 | 24532 | ${}^mC_{es}{}^mC_{eo}T_{eo}T_{es}T_{es}G_{ds}{}^mC_{ds}T_{ds}T_{ds}{}^mC_{ds}T_{ds}T_{ds}T_{ds}T_{ds}A_{ds}G_{eo}T_{es}T_{es}G_{e}$ | 9 | 276 |
| 650633 | N/A | N/A | 28195 | 28212 | ${}^mC_{es}{}^mC_{eo}T_{eo}T_{eo}{}^mC_{es}A_{ds}T_{ds}{}^mC_{ds}A_{ds}A_{ds}{}^mC_{ds}T_{ds}T_{ds}{}^mC_{eo}T_{eo}G_{es}A_{es}G_{e}$ | 38 | 277 |
| 650634 | N/A | N/A | 28217 | 28234 | $G_{es}A_{eo}G_{eo}G_{eo}T_{es}{}^mC_{ds}A_{ds}G_{ds}{}^mC_{ds}T_{ds}G_{ds}A_{ds}A_{ds}T_{ds}{}^mC_{eo}A_{eo}G_{es}A_{es}A_{e}$ | 25 | 278 |
| 650635 | N/A | N/A | 28222 | 28239 | $A_{es}A_{Co}G_{eo}A_{eo}G_{es}G_{ds}A_{ds}T_{ds}G_{ds}T_{ds}{}^mC_{ds}A_{ds}G_{ds}{}^mC_{eo}T_{eo}G_{es}A_{es}T_{e}$ | 12 | 279 |
| 650640 | N/A | N/A | 1233 | 1250 | ${}^mC_{es}G_{eo}{}^mC_{eo}{}^mC_{eo}G_{es}G_{ds}G_{ds}{}^mC_{ds}G_{ds}A_{ds}G_{ds}A_{ds}T_{ds}{}^mC_{eo}G_{eo}G_{es}{}^mC_{es}A_{e}$ | 0 | 280 |
| 650641 | N/A | N/A | 1754 | 1771 | ${}^mC_{es}{}^mC_{eo}{}^mC_{eo}G_{eo}T_{es}A_{ds}A_{ds}T_{ds}A_{ds}A_{ds}A_{ds}A_{ds}A_{ds}{}^mC_{eo}T_{eo}{}^mC_{es}T_{es}T_{e}$ | 8 | 281 |
| 650642 | N/A | N/A | 1820 | 1837 | ${}^mC_{es}T_{eo}A_{eo}A_{eo}A_{es}A_{ds}{}^mC_{ds}A_{ds}A_{ds}A_{ds}A_{ds}G_{ds}{}^mC_{ds}T_{eo}G_{eo}G_{es}{}^mC_{es}{}^mC_{e}$ | 17 | 282 |
| 650643 | N/A | N/A | 7243 7283 | 7260 7300 | $A_{es}T_{eo}A_{eo}G_{eo}{}^mC_{es}A_{ds}T_{ds}T_{ds}A_{ds}{}^mC_{ds}T_{ds}A_{ds}T_{ds}T_{eo}T_{eo}G_{es}T_{es}A_{e}$ | 0 | 283 |
| 650644 | N/A | N/A | 8090 | 8107 | ${}^mC_{es}A_{eo}G_{eo}A_{eo}G_{es}T_{ds}T_{ds}T_{ds}{}^mC_{ds}T_{ds}A_{ds}{}^mC_{ds}T_{ds}T_{eo}A_{eo}T_{es}A_{es}T_{e}$ | 8 | 284 |
| 650645 | N/A | N/A | 9762 | 9779 | $T_{es}T_{eo}A_{eo}A_{eo}{}^mC_{es}A_{ds}T_{ds}A_{ds}G_{ds}G_{ds}T_{ds}A_{ds}{}^mC_{ds}A_{eo}T_{eo}G_{es}{}^mC_{es}A_{e}$ | 28 | 285 |
| 650646 | N/A | N/A | 10816 | 10833 | $A_{es}A_{Co}G_{eo}T_{es}G_{ds}A_{ds}G_{ds}{}^mC_{ds}{}^mC_{ds}T_{ds}T_{ds}{}^mC_{ds}T_{ds}T_{eo}G_{eo}{}^mC_{es}T_{es}A_{e}$ | 0 | 286 |
| 650647 | N/A | N/A | 10975 | 10992 | $A_{es}A_{eo}T_{eo}{}^mC_{eo}A_{es}T_{ds}A_{ds}{}^mC_{ds}T_{ds}G_{ds}T_{ds}A_{ds}A_{eo}A_{eo}A_{es}A_{es}A_{e}$ | 36 | 287 |
| 650648 | N/A | N/A | 11515 | 11532 | $T_{es}T_{eo}{}^mC_{eo}{}^mC_{eo}A_{es}G_{ds}A_{ds}A_{ds}G_{ds}G_{ds}{}^mC_{ds}T_{ds}G_{ds}{}^mC_{eo}T_{eo}G_{es}T_{es}T_{e}$ | 30 | 288 |
| 650649 | N/A | N/A | 11609 | 11626 | $A_{es}A_{eo}A_{eo}G_{eo}G_{es}{}^mC_{ds}T_{ds}G_{ds}T_{ds}G_{ds}A_{ds}A_{ds}A_{ds}{}^mC_{eo}G_{eo}G_{es}T_{es}G_{e}$ | 35 | 289 |

TABLE 1-continued

Percent reduction of human ATXN3 mRNA by modified oligonucleotides relative to control

| IONIS No | SEQ ID No: 1 Start Site | SEQ ID No: 1 Stop Site | SEQ ID No: 2 Start Site | SEQ ID No: 2 Stop Site | Sequence (5' to 3') | % Inhib. | SEQ ID No |
|---|---|---|---|---|---|---|---|
| 650650 | N/A | N/A | 11690 11984 | 11707 12001 | $A_{es}A_{eo}A_{eo}A_{eo}A_{es}T_{ds}{}^{m}C_{ds}T_{ds}A_{ds}G_{ds}T_{ds}A_{ds}{}^{m}C_{ds}T_{eo}{}^{m}C_{eo}T_{es}A_{es}G_{e}$ | 26 | 290 |
| 650651 | N/A | N/A | 15320 | 15337 | $A_{es}G_{eo}{}^{m}C_{eo}T_{eo}G_{es}G_{ds}T_{ds}T_{ds}T_{ds}T_{ds}{}^{m}C_{ds}A_{ds}A_{ds}T_{eo}A_{eo}A_{es}{}^{m}C_{es}{}^{m}C_{e}$ | 23 | 291 |
| 650652 | N/A | N/A | 16170 16488 | 16187 16505 | $A_{es}G_{eo}A_{eo}A_{eo}A_{es}G_{ds}A_{ds}A_{ds}{}^{m}C_{ds}{}^{m}C_{ds}A_{ds}A_{ds}{}^{m}C_{ds}T_{eo}T_{eo}A_{es}G_{es}G_{e}$ | 10 | 292 |
| 650653 | N/A | N/A | 17193 | 17210 | $A_{es}T_{eo}T_{eo}T_{eo}A_{es}A_{ds}{}^{m}C_{ds}{}^{m}C_{ds}A_{ds}{}^{m}C_{ds}A_{ds}A_{ds}G_{eo}A_{eo}T_{es}A_{es}{}^{m}C_{e}$ | 2 | 293 |
| 650654 | N/A | N/A | 17686 | 17703 | ${}^{m}C_{es}A_{eo}T_{eo}G_{eo}{}^{m}C_{es}A_{ds}G_{ds}{}^{m}C_{ds}T_{ds}{}^{m}C_{ds}A_{ds}T_{ds}G_{ds}{}^{m}C_{eo}{}^{m}C_{eo}T_{es}A_{es}T_{e}$ | 8 | 294 |
| 650655 | N/A | N/A | 17703 | 17720 | $T_{es}{}^{m}C_{eo}A_{eo}{}^{m}C_{eo}T_{es}A_{ds}A_{ds}A_{ds}T_{ds}T_{ds}A_{ds}G_{ds}{}^{m}C_{ds}T_{eo}G_{eo}G_{es}G_{es}{}^{m}C_{e}$ | 25 | 295 |
| 650656 | N/A | N/A | 18799 | 18816 | $A_{es}A_{eo}G_{eo}T_{eo}T_{es}A_{ds}G_{ds}T_{ds}G_{ds}T_{ds}A_{ds}T_{ds}A_{ds}T_{eo}T_{eo}A_{es}T_{es}A_{e}$ | 0 | 296 |
| 650657 | N/A | N/A | 20598 | 20615 | $T_{es}{}^{m}C_{eo}T_{eo}{}^{m}C_{eo}A_{es}G_{ds}{}^{m}C_{ds}A_{ds}G_{ds}A_{ds}A_{ds}T_{ds}G_{ds}T_{eo}A_{eo}A_{es}{}^{m}C_{es}G_{e}$ | 16 | 297 |
| 650658 | N/A | N/A | 23358 | 23375 | $A_{es}A_{eo}{}^{m}C_{eo}T_{eo}A_{es}G_{ds}T_{ds}A_{ds}A_{ds}{}^{m}C_{ds}A_{ds}T_{ds}G_{ds}G_{eo}{}^{m}C_{eo}T_{es}A_{es}A_{e}$ | 16 | 298 |
| 650659 | N/A | N/A | 24393 | 24410 | $A_{es}T_{eo}A_{eo}T_{eo}A_{es}G_{ds}A_{ds}A_{ds}T_{ds}A_{ds}A_{ds}{}^{m}C_{ds}{}^{m}C_{ds}T_{eo}A_{eo}A_{es}A_{es}A_{e}$ | 0 | 299 |
| 650660 | N/A | N/A | 25114 | 25131 | $A_{es}A_{eo}G_{eo}G_{eo}{}^{m}C_{es}A_{ds}T_{ds}T_{ds}T_{ds}G_{ds}T_{ds}A_{ds}A_{ds}T_{eo}G_{eo}T_{es}A_{es}A_{e}$ | 22 | 300 |
| 650661 | N/A | N/A | 26689 | 26706 | $A_{es}{}^{m}C_{eo}{}^{m}C_{eo}A_{eo}A_{es}{}^{m}C_{ds}T_{ds}A_{ds}{}^{m}C_{ds}T_{ds}T_{ds}T_{ds}A_{ds}{}^{m}C_{eo}T_{eo}T_{es}T_{es}T_{e}$ | 0 | 301 |
| 650662 | N/A | N/A | 26813 | 26830 | $T_{es}G_{eo}{}^{m}C_{eo}{}^{m}C_{eo}{}^{m}C_{es}G_{ds}T_{ds}{}^{m}C_{ds}{}^{m}C_{ds}T_{ds}A_{ds}T_{ds}T_{ds}T_{eo}G_{eo}{}^{m}C_{es}T_{es}G_{e}$ | 10 | 302 |
| 650663 | N/A | N/A | 27243 | 27260 | $G_{es}T_{eo}{}^{m}C_{eo}{}^{m}C_{eo}T_{es}A_{ds}A_{ds}T_{ds}T_{ds}T_{ds}{}^{m}C_{ds}A_{ds}T_{ds}T_{eo}T_{eo}T_{es}T_{es}{}^{m}C_{e}$ | 0 | 303 |
| 650664 | N/A | N/A | 28181 | 28198 | $T_{es}G_{eo}A_{eo}G_{eo}T_{es}G_{ds}T_{ds}G_{ds}A_{ds}{}^{m}C_{ds}T_{ds}T_{ds}A_{eo}A_{es}A_{es}A_{e}$ | 12 | 304 |
| 650665 | N/A | N/A | 28226 | 28243 | ${}^{m}C_{es}A_{eo}T_{eo}T_{eo}A_{es}A_{ds}G_{ds}A_{ds}G_{ds}G_{ds}A_{ds}T_{ds}G_{ds}T_{eo}{}^{m}C_{eo}A_{es}G_{es}{}^{m}C_{e}$ | 16 | 305 |
| 650666 | N/A | N/A | 28231 | 28248 | $T_{es}{}^{m}C_{eo}T_{eo}{}^{m}C_{eo}A_{es}{}^{m}C_{ds}A_{ds}T_{ds}T_{ds}A_{ds}A_{ds}G_{ds}A_{ds}G_{eo}G_{eo}A_{es}T_{es}G_{e}$ | 26 | 306 |
| 650667 | N/A | N/A | 28236 | 28253 | $A_{es}A_{eo}A_{eo}T_{eo}A_{es}T_{ds}{}^{m}C_{ds}T_{ds}{}^{m}C_{ds}A_{ds}{}^{m}C_{ds}A_{ds}T_{ds}T_{eo}A_{eo}A_{es}G_{es}A_{e}$ | 12 | 307 |
| 650668 | N/A | N/A | 28266 | 28283 | $A_{es}G_{eo}{}^{m}C_{eo}{}^{m}C_{eo}A_{es}T_{ds}T_{ds}A_{ds}A_{ds}A_{ds}T_{ds}{}^{m}C_{ds}T_{ds}A_{ds}T_{eo}A_{eo}{}^{m}C_{es}T_{es}G_{e}$ | 57 | 308 |
| 650669 | N/A | N/A | 35157 | 35174 | $A_{es}G_{eo}A_{eo}T_{eo}T_{es}T_{ds}G_{ds}A_{ds}A_{ds}A_{ds}T_{ds}T_{ds}T_{ds}T_{eo}G_{eo}G_{es}A_{es}T_{e}$ | 0 | 309 |
| 650670 | N/A | N/A | 35981 | 35998 | $A_{es}A_{eo}T_{eo}G_{eo}A_{es}G_{ds}T_{ds}G_{ds}T_{ds}T_{ds}G_{ds}G_{ds}T_{ds}T_{eo}T_{eo}A_{es}T_{es}A_{e}$ | 38 | 310 |
| 650671 | N/A | N/A | 38694 | 38711 | $T_{es}A_{eo}G_{eo}A_{eo}A_{es}A_{ds}A_{ds}A_{ds}A_{ds}G_{ds}T_{ds}A_{ds}{}^{m}C_{ds}{}^{m}C_{eo}A_{eo}G_{es}T_{es}T_{e}$ | 11 | 311 |
| 650672 | N/A | N/A | 43232 | 43249 | $G_{es}{}^{m}C_{eo}A_{eo}T_{eo}{}^{m}C_{es}A_{ds}{}^{m}C_{ds}{}^{m}C_{ds}T_{ds}G_{ds}T_{ds}T_{ds}G_{ds}G_{eo}G_{eo}A_{es}A_{es}A_{e}$ | 14 | 312 |

Subscripts:
$_e$ represents a 2'-MOE nucleoside;
$_d$ represents a 2'-deoxynucleoside;
$_s$ represents a phosphorothioate internucleoside linkage; and
$_o$ represents a phosphodiester internucleoside linkage.
Superscript '$m$' preceding a 'C' indicates that the cytosine is a 5-methylcytosine.

Additional modified oligonucleotide were designed targeting the ATXN3 nucleic acid sequences listed in Table 2.

TABLE 2

ATXN3 nucleic acids

| GenBank Accession number | Human ATXN3 transcript variant name | SEQ ID No |
|---|---|---|
| NM_001164778.1 | transcript variant o, mRNA | 3 |
| NM_001127696.1 | transcript variant ad, mRNA | 4 |
| NM_001164781.1 | transcript variant y, mRNA | 5 |
| NR_028454.1 | transcript variant d, non-coding | 6 |
| NM_001164780.1 | transcript variant u, mRNA | 7 |
| NR_028469.1 | transcript variant af, non-coding | 8 |
| NM_001164779.1 | transcript variant r, mRNA | 9 |
| NR_028461.1 | transcript variant p, non-coding | 10 |
| NR_028466.1 | transcript variant x, non-coding | 11 |
| NR_028462.1 | transcript variant q, non-coding | 12 |
| NR_028467.1 | transcript variant z, non-coding | 13 |
| NR_031765.1 | transcript variant c, non-coding | 14 |
| NM_001164782.1 | transcript variant ae, mRNA | 15 |

TABLE 2-continued

ATXN3 nucleic acids

| GenBank Accession number | Human ATXN3 transcript variant name | SEQ ID No |
|---|---|---|
| NR_028465.1 | transcript variant w, non-coding | 16 |
| NR_028457.1 | transcript variant k, non-coding | 17 |
| NM_001164777.1 | transcript variant j, mRNA | 18 |
| NM_001164774.1 | transcript variant b, mRNA | 19 |

Modified oligonucleotides complementary to the ATXN3 nucleic acids from Table 2 were tested for the effect on ATXN3 mRNA according to the protocol described above. The modified oligonucleotides in the table below were designed as 5-8-5 MOE gapmers. The gapmers are 18 nucleosides in length, wherein the central gap segment comprises eight 2'-deoxynucleosides and is flanked by wing segments on both the 5' end and on the 3' end comprising five nucleosides each. Each nucleoside in the 5' wing segment and each nucleoside in the 3' wing segment comprises a MOE modification. All cytosine residues throughout each gapmer are 5-methylcytosines. The internucleoside linkages are mixed phosphodiester and phosphorothioate linkages. The internucleoside linkages are arranged in order from 5' to 3': sooosssssssssooss; wherein ("o") is phosphodiester and ("s") is phosphorothioate. "Start site" indicates the 5'-most nucleoside to which the gapmer is targeted in the human gene sequence. "Stop site" indicates the 3'-most nucleoside to which the gapmer is targeted human gene sequence.

TABLE 3

Percent reduction of human ATXN3 mRNA by modified oligonucleotides relative to control

| IONIS No | Target SEQ ID No | Start Site | Stop Site | Sequence (5' to 3') | % In-hib. | SEQ ID No |
|---|---|---|---|---|---|---|
| 650361 | 3 | 443 | 460 | $^mC_{es}T_{eo}G_{eo}T_{eo}{}^mC_{es}T_{ds}G_{ds}T_{ds}T_{ds}T_{ds}T_{ds}{}^mC_{ds}{}^mC_{ds}T_{eo}A_{eo}A_{es}T_{es}T_e$ | 1 | 313 |
| 650611 | 4 | 248 | 265 | $T_{es}T_{eo}A_{eo}T_{eo}A_{es}A_{ds}{}^mC_{ds}{}^mC_{ds}T_{ds}G_{ds}T_{ds}A_{ds}A_{ds}A_{eo}A_{eo}A_{es}{}^mC_{es}G_e$ | 48 | 314 |
| 650613 | 5 | 87 | 104 | $T_{es}T_{eo}G_{eo}{}^mC_{eo}T_{es}T_{ds}A_{ds}T_{ds}A_{ds}A_{ds}{}^mC_{ds}T_{ds}T_{ds}T_{eo}{}^mC_{eo}T_{es}{}^mC_{es}G_e$ | 0 | 315 |
| 650614 | 6 | 128 | 145 | $T_{es}T_{eo}{}^mC_{eo}A_{eo}T_{es}T_{ds}T_{ds}{}^mC_{ds}T_{ds}G_{ds}A_{ds}A_{ds}T_{ds}A_{eo}G_{eo}A_{es}G_{es}A_e$ | 8 | 316 |
| 650615 | 7 | 87 | 104 | $A_{es}T_{eo}{}^mC_{eo}T_{eo}T_{es}T_{ds}{}^mC_{ds}A_{ds}T_{ds}T_{ds}T_{ds}T_{ds}T_{eo}{}^mC_{eo}T_{es}{}^mC_{es}G_e$ | 7 | 317 |
| 650618 | 8 | 687 | 704 | $G_{es}T_{eo}{}^mC_{eo}A_{eo}A_{es}{}^mC_{ds}T_{ds}A_{ds}{}^mC_{ds}T_{ds}T_{ds}T_{ds}A_{ds}{}^mC_{eo}T_{eo}T_{es}T_{es}T_e$ | 5 | 318 |
| 650620 | 9 | 87 | 104 | $A_{es}A_{eo}G_{eo}T_{eo}T_{es}A_{ds}A_{ds}A_{ds}{}^mC_{ds}{}^mC_{ds}A_{ds}T_{ds}T_{ds}T_{eo}{}^mC_{eo}T_{es}{}^mC_{es}G_e$ | 20 | 319 |
| 650621 | 10 | 443 | 460 | $T_{es}A_{eo}A_{eo}{}^mC_{eo}{}^mC_{es}T_{ds}G_{ds}T_{ds}T_{ds}T_{ds}T_{ds}{}^mC_{ds}{}^mC_{ds}T_{eo}A_{eo}A_{es}T_{es}T_e$ | 2 | 320 |
| 650622 | 11 | 87 | 104 | $T_{es}A_{eo}T_{eo}A_{eo}G_{es}A_{ds}A_{ds}T_{ds}A_{ds}A_{ds}{}^mC_{ds}T_{ds}T_{ds}T_{eo}{}^mC_{eo}T_{es}{}^mC_{es}G_e$ | 3 | 321 |
| 650623 | 12 | 443 | 460 | $^mC_{es}{}^mC_{eo}{}^mC_{eo}T_{eo}T_{es}{}^mC_{ds}{}^mC_{ds}T_{ds}G_{ds}T_{ds}T_{ds}G_{ds}T_{ds}A_{eo}A_{eo}T_{es}T_{es}G_e$ | 23 | 322 |
| 650619 | 13 | 290 | 307 | $A_{es}{}^mC_{eo}{}^mC_{eo}A_{eo}{}^mC_{es}T_{ds}G_{ds}A_{ds}A_{ds}T_{ds}A_{ds}G_{ds}A_{ds}G_{eo}A_{eo}A_{es}A_{es}A_e$ | 27 | 323 |
| 650624 | 13 | 375 | 392 | $A_{es}{}^mC_{eo}T_{eo}T_{eo}{}^mC_{es}{}^mC_{ds}T_{ds}G_{ds}T_{ds}T_{ds}G_{ds}T_{ds}A_{ds}A_{eo}T_{eo}T_{es}G_{es}A_e$ | 9 | 324 |
| 650627 | 13 | 471 | 488 | $A_{es}T_{eo}{}^mC_{eo}A_{eo}{}^mC_{es}{}^mC_{ds}T_{ds}T_{ds}A_{ds}{}^mC_{ds}T_{ds}A_{ds}G_{ds}T_{eo}A_{eo}A_{es}A_{es}G_e$ | 9 | 325 |
| 650628 | 14 | 87 | 104 | $T_{es}T_{eo}T_{eo}T_{eo}A_{es}T_{ds}G_{ds}G_{ds}A_{ds}{}^mC_{ds}T_{ds}T_{ds}T_{ds}T_{eo}{}^mC_{eo}T_{es}{}^mC_{es}G_e$ | 0 | 326 |
| 650630 | 15 | 87 | 104 | $T_{es}T_{eo}T_{eo}G_{eo}{}^mC_{es}T_{ds}G_{ds}{}^mC_{ds}T_{ds}G_{ds}G_{ds}T_{ds}T_{ds}T_{eo}{}^mC_{eo}T_{es}{}^mC_{es}G_e$ | 11 | 327 |
| 650631 | 16 | 248 | 265 | $T_{es}T_{eo}{}^mC_{eo}A_{eo}T_{es}T_{ds}T_{ds}{}^mC_{ds}T_{ds}G_{ds}T_{ds}A_{ds}A_{ds}A_{eo}A_{eo}A_{es}{}^mC_{es}G_e$ | 17 | 328 |
| 650632 | 16 | 794 | 811 | $A_{es}T_{eo}T_{eo}T_{eo}T_{es}{}^mC_{ds}A_{ds}A_{ds}A_{ds}G_{ds}T_{ds}A_{ds}G_{ds}G_{eo}{}^mC_{eo}T_{es}T_{es}{}^mC_e$ | 0 | 329 |
| 650636 | 16 | 848 | 865 | $T_{es}A_{eo}T_{eo}T_{eo}A_{es}A_{ds}G_{ds}A_{ds}G_{ds}G_{ds}A_{ds}T_{ds}G_{ds}T_{eo}{}^mC_{eo}A_{es}G_{es}{}^mC_e$ | 6 | 330 |
| 650637 | 17 | 535 | 552 | $A_{es}A_{eo}{}^mC_{eo}T_{eo}T_{es}A_{ds}{}^mC_{ds}T_{ds}A_{ds}A_{ds}G_{ds}T_{ds}A_{ds}A_{ds}A_{eo}G_{eo}T_{es}{}^mC_{es}G_e$ | 20 | 331 |
| 650610 | 18 | 87 | 104 | $^mC_{es}{}^mC_{eo}A_{eo}G_{eo}A_{es}A_{ds}G_{ds}G_{ds}{}^mC_{ds}T_{ds}G_{ds}T_{ds}T_{ds}T_{eo}{}^mC_{eo}T_{es}{}^mC_{es}G_e$ | 0 | 332 |
| 650638 | 18 | 125 | 142 | $^mC_{es}T_{eo}G_{eo}T_{eo}{}^mC_{es}T_{ds}G_{ds}A_{ds}A_{ds}T_{ds}A_{ds}G_{ds}A_{ds}G_{eo}A_{eo}A_{es}A_{es}A_e$ | 1 | 333 |
| 650639 | 19 | 248 | 265 | $^mC_{es}T_{eo}G_{eo}{}^mC_{eo}T_{es}G_{ds}T_{ds}{}^mC_{ds}T_{ds}G_{ds}T_{ds}A_{ds}A_{ds}A_{eo}A_{eo}{}^mC_{es}G_e$ | 0 | 334 |

Subscripts:
$_e$ represents a 2'-MOE nucleoside;
$_d$ represents a 2'-deoxynucleoside;
$_s$ represents a phosphorothioate internucleoside linkage; and
$_o$ represents a phosphodiester internucleoside linkage.
Superscript '$^m$' preceding a 'C' indicates that the cytosine is a 5-methylcytosine.

Example 2: Effect of Modified Oligonucleotides on Human ATXN3 In Vitro, Multiple Doses Modified oligonucleotides selected from Example 1 were also tested at various doses in HepG2 cells in studies of in vitro reduction of human ATXN3 mRNA. The modified oligonucleotides were tested in a series of experiments that had similar culture conditions.

Cells were plated at a density of 20,000 cells per well and transfected using electroporation with 0.11 µM, 0.33 µM, 1.00 µM, 3.00 µM, and 9.00 µM concentrations of modified oligonucleotide, as specified in the table below. After a treatment period of approximately 16 hours, RNA was isolated from the cells and ATXN3 mRNA levels were measured by quantitative real-time PCR. Human ATXN3 primer probe set RTS4392 was used to measure mRNA levels. ATXN3 mRNA levels were adjusted according to total RNA content, as measured by RIBOGREEN®. Results are presented as percent reduction of ATXN3, relative to untreated control cells. "0" indicate that the antisense oligonucleotide did not reduce ATXN3 mRNA levels. The half maximal inhibitory concentration ($IC_{50}$) of each oligonucleotide is also presented in the table below.

TABLE 4

Percent reduction of human ATXN3 mRNA by modified oligonucleotides relative to control

| IONIS No | 0.11 µM | 0.33 µM | 1.00 µM | 3.00 µM | 9.00 µM | $IC_{50}$ (µM) |
|---|---|---|---|---|---|---|
| 650372 | 2 | 24 | 39 | 76 | 80 | 1.4 |
| 650379 | 6 | 13 | 29 | 52 | 66 | 3.2 |
| 650410 | 16 | 20 | 42 | 68 | 85 | 1.3 |
| 650437 | 0 | 32 | 59 | 77 | 90 | 1.0 |
| 650438 | 8 | 19 | 42 | 68 | 78 | 1.5 |
| 650466 | 15 | 15 | 45 | 53 | 76 | 1.9 |
| 650494 | 15 | 17 | 32 | 53 | 82 | 1.9 |
| 650507 | 9 | 8 | 37 | 59 | 81 | 1.9 |
| 650512 | 2 | 23 | 46 | 73 | 82 | 1.3 |
| 650513 | 25 | 42 | 63 | 72 | 84 | 0.6 |
| 650528 | 8 | 32 | 47 | 68 | 81 | 1.2 |
| 650532 | 1 | 20 | 31 | 60 | 76 | 2.0 |
| 650578 | 9 | 24 | 41 | 54 | 64 | 2.5 |
| 650668 | 1 | 19 | 41 | 65 | 77 | 1.7 |

Example 3: Acute Tolerability of Modified Oligonucleotides Complementary to Human ATXN3 in C57BL/6 Mice Modified oligonucleotides selected from the examples above were tested in mice to assess tolerability of the oligonucleotides in vivo. Female wild type C57BL/6 mice were divided into treatment groups consisting of four mice. The mice were administered a single intracerebroventricular (ICV) dose of 700 lag of a modified oligonucleotide listed in the table below. One group of four mice was administered a single ICV dose of PBS as a control to which the modified oligonucleotide treated groups was compared.

At 3 hours post injection, each mouse was evaluated according to 7 different criteria. The 7 criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to a tail pinch; (7) regular breathing. For each of the 7 different criteria, each mouse was given a sub-score of 0 if it met the criteria or 1 if it did not. After all of the 7 criteria were evaluated, the sub-scores were summed for each mouse and then averaged for each group. For example, if a mouse was bright, alert, and responsive 3 hours after the 700 µg ICV dose, and met all other criteria, it would get a summed score of 0. If another mouse was not bright, alert, and responsive 3 hours after the 700 µg ICV dose but met all other criteria, it would receive a score of 1. The results are presented as the average score for each treatment group.

TABLE 5

Acute tolerability scores

| Treatment (IONIS No) | Score |
|---|---|
| PBS | 0.00 |
| 650372 | 5.25 |
| 650410 | 3.25 |
| 650438 | 6.50 |
| 650507 | 0.75 |
| 650512 | 1.25 |
| 650513 | 6.00 |
| 650528 | 2.50 |
| 650668 | 3.25 |

Example 4: Acute Tolerability of Modified Oligonucleotides Complementary to Human ATXN3 in Sprague Dawley Rats (3 mg)

Sprague Dawley rats were separated into groups of 4 rats for the experiment presented in the table below. Each rat in each group of rats was administered a single 3 mg intrathecal (IT) dose of an oligonucleotide described in example 1 or example 2 above. At 3 hours after injection, the movement of 7 different parts of the body was evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was paralyzed. After each of the 7 body parts were evaluated, the sub-scores were summed for each rat and then averaged for each group (the functional observational battery score or FOB). For example, if a rat's tail, head, and all other evaluated body parts were moving 3 hours after the 3 mg IT dose, it would get a summed score of 0. If another rat was not moving its tail 3 hours after the 3 mg IT dose but all other evaluated body parts were moving, it would receive a score of 1. Saline treated rats generally receive a score of 0. A score of at the top end of the range would be suggestive of acute toxicity. Results are presented as the average score for each treatment group.

TABLE 6

Acute tolerability scores

| Compound ID | 3 hr FOB |
|---|---|
| PBS | 0.50 |
| 650410 | 3.25 |
| 650507 | 0.25 |
| 650512 | 0.75 |
| 650528 | 1.75 |
| 650668 | 1.75 |

SEQUENCE LISTING (646 sequences)

SEQ ID NO: 1 - RNA, 6923 nt, Homo sapiens
  source 1..6923: mol_type = mRNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 2 - DNA, 50001 bp, Homo sapiens
  source 1..50001: mol_type = genomic DNA
gtttcatcaaaccgctgctacctccccgtctcccacacaatttatgggacttctaagttccctctaaagggtccgaacacctacactggtaacaagccacctggatttgaatcctggcaagacaacttactatctgaccttggacattgtgctgttcttaacctctccgtgcctcggtttcctcatgtgtatgaataacatcaacacctacatcaaagtttgctgtattaaatttgataatatatgcaaagcatttagaaaagtgcctagctcatagaaagccttatgtaaatattaactatcattttttttcttttttggggtggtgggggaggggtttcgcttttgttgcccaggctggcgtgcaatggcacgatctcggctcaccacaacctcggcctcccgggttcaagcgattctcctgcctcagcctcccgagtacctgggattacaggcatgcaccaccacgcccgggtaattttgtatttttagtggagacggggtttctccatgttggtcaggctgatctcaaactcccgacctcaggtgatccgcccgcctcggcctcccaaagtgctgggattacaagcgtgaagcacctcgcccggcctagctatcatttttatacaagtgctgggttttgggagaatgtaatgatggcttttttcttactaaactttcagtgcaggaggaggagaaagaaagtaaatagttatatgaacacagtagaaagtcaaagtggaaaacaaaaagaacatagaacccaggtgagcggtccagacctccccccagaaacctaagaatccatagaaatgggtgggaagcggagaagatcctccagacagcaggtggcgatgtagcatcccccagaaggcccgctaacagaagctaggaggacgcgctaccaaggtcacgtgtccccggcgttcactcgctcttcgcttcacgacactcgcatcctcacgggtgattggtctgcgtgcggcacgtgggcggggtaccggggcgggccggggaggggcggggtgggcggaggagaggggcagggggcggagctggagggggtggttcggcgtgggggccgttggctccagacaaataaacatggagtccatcttccacgagaaagtgagtgtccgcgttcggtggggagctgtctgccgcgcggtggcgggcgtggagcgcggcatcaccgcctctcggagggctgggtggggcccgagtcgcccccatgccgatctcgcccggcgaggggcgacgccgcagcctcccgcctcctcggctcgaggaggggagcatcacctacgcccctacttcccccgcggcccccgccctgggagccgggagggagtatgggcggggccgggggcgtctcgggacacgggagtggggtggcgcccagtgggtttgcttctgcctttctccgtcactttccatcgcttttcggaggattccttcacccctccccaatccttccctctccctagggtctagctagagtcatctctgggacacctccctcaacccctcctaccctaatcctggcagaattaacttttcctcctccggactgctcaattctatattggagtcttccctacacgtagatctttggggtcttgttcgtgtctttcccctgcactaggtccgcgagcctcccgagggaggagaccttggctcgcccactgtagggcctgacatttaggaagtgaagtaggaaacccggcgtgcccctaaacagggaagtcgtcacaagagtttttattacgggatgtttgggtttggtttcttttggtactcccatctttccggagcaggcggccagctttgtttttaggtattaggagtggactgggatgattttgttgtagtctgcctagcctgctgtccctttaactcttccgtgaccatgcacttgaagatactgtttgtgatatgtaaagaaactcctcgtttctctcatactattatccagccatttgtgtgtgagtgaagccttccccaggacagctttggcacatggtatcatgtttcataatagtttcgtgtttggaaagagttgctggtaaggctgttatttaataggaggagcaaagggtttttgttttattaaatacttataaatgatcatttatcccagacatttaaaattcacacacacacaacaaataaagcaaagacaaaagaatacatttaccaaatgtaaatctgtagcataaattttttttaatttttattttaaagatggggtctcattctgtcacccaggcaggtgtgcaatggagagatcatggctcactgcagccttgatctcctaggcacaagcgatcctcccgcctctgcctccagagtagctgggactacaggtgcatatcgccagggccaggtaatgtttttgggagagacggggtctcgctgtgttgcccaggctggtctcgaactcctggactcaggtgattctcccacctcggcctctcgaagtgctgtgattacaggcgtgagccactgtgcctggaacaaattgttaagtacaatgcttttcattgtagaaaacatctcggaaacttttgaaataggctgatgttcagtgggggaggaaggactcagtcgtatagttgtcactaattttttgacttgattgacatgactcgtaaatcatagacaatagagatttggttgcttggctgagtagagtgcgtgaaaaatacacacgtacttttttttttttttttttgagatggagtttggctcttgtcacccaggctggagtgcaatggcgccatcatggctcactgcaacctccgcctccccgttcaagcgattctcctgcctcagtctccccagtagctgagattacaggcgcccgccaccacgcccagctaatttttgtatttttagtagagacagggtttcaccatgttggccaggctggtctccaactcctgacaggtggtccgcccgcctcggcctcccaaagtgctgggattacaggcgtgagccaccgcacccggccatatttttgttattaattttcaaaggctttggtgtgggaccacatttcaacatggaaggccttaaacatgttccacactacttcctgagaattagacaagatttttaacaatattgttacctagttgggacacatttgtactgacccatgggatgaaaaaaagctgagtgctagcctagtgaaaatctacttacccgaaagaaatccctcttagtctgggtgcagtggctcacaccagtgctttgggaggcccagacgggcggatcatgaggtcagtagtttgagaccagcctggccaacatggtgaaaccccgtctctactaaaaatacaaaaaattagccaggtgtggtggcaggcgcctgtaatcccaggtactctggaggctgaggcaggagaattgcttgaacccgagaggcagaggttgcagtgagccgagaccgtgccactgcacttcagcctgggcaacagagcgagactccgtctcaaaaaaaagaaaaggaaaaaagagtccctcttaattatcagcatgtgtataggcctacagatacttcaggaatacctttaccattatcatcaacttgtatctacatagcatgtgaagattcaacaatttagttttttgggcgtcctcaagagtacgcacctataaccatatggcccaattgttaatctcctatacagtccattctgggaatgtttgggcttactgtgccatttttccgttcactgccttcccctctgcaatatacctttaacccttgctaggtcctgggtttggagagccagagaaccaactttggccctaaagaagctgtgtaggtagcaatatctgcctacgaagggccttgcaaccatttcctcttggaaccttggtttcctctttctgagtagtcactttgagtaccctttattaagttagaatgtaaaaacagtttctcactgatatatctgcagtgcctgagagagggcctggcacagagtaagtactcaataaatatttgaatggggccgggcgtggtgagacctgtctctacaagaatgaacaaaattagctgggcgtgttagcacatgcctgtagacttgggaggctgaggtgggaggattgcatgagtctgggaggtcgaggctgtagtgagccatgatcgcaccactgcactccagcctaggggacagagcaagatcctgtctcaaaagaaaaaaatgtatatatttgaatggataaagagatggctttgagtttctgagatatatatggtgctgtttatctaaagtaaacaagttttctgtaaatattttaaggctttgcaggccagctgtagtctctgtcacacattcttatttgtgcatgtttttcccaaccatgtaaaaatgtaaagtgcattcttagctactggggcaggttgaatttggcccatgggctagagtttgccaacccctaacttaaacctttgtactaactttatgaccactactggatttttgttgttgtttgttttagttctggtgcctgctttgtttttttttttttttttaatcctcttgctgatgtttcttggtgcagttactgtgccatttgtattggtgcttttaatgtaatgcaaactggtaataatatctaaacttgctggggttgtacataaaattattgaaaagattgaaaagatgctgagcattgactctgtggcattcattatgcccttttgtgattgctggattttagccatctttaggacatttgagctttaggagaagccaaattctgtataaatgacttgaagtgctaatagcacaggttttgaaacctctgcctgggtttgagtctcagctctgccttttactacctgtgtgatcctgagcaagttacttagtatccctgtcctctagtttcctcctctgtagtgtggggataataacatagacataacctgagagttagagtgtagagaaggctccctggcagatagtgctgtagaagtactggccattgccattactcaggtgcttgtgtttgctgaacctcatagtaagggctcggagagcactaagaggaggtgagaaatgctgctagattgacagcttgtccccagatagcccattcccgagagcaccttaggtttatacctgatttgtgttgtagttagtagtgtctctggtaatttgaactagtttcaggttggtcttgaaaacctggggaggttgggggtaaatgatttggtagcagttctcttttgtgattttatacattatctttgtagaactgcagtttgctaattctctgagcccaacacaatgaagtctgggcctaaaatcatagaatttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccaggctggagtgcagtggcgcgaactcagctcactgcaacctccgtctcctgagttcaagagattctcctgcctcagcctcccgagtagctgggactataggcatgtgccaccatgcccagctaattttcttatttttagtagagacgaggtttcaccatgttggccaggatggtcttgatctcttgacctcgtgatccacctgcctcagcctcccaaagtgcggggattacaggcgtgagctaccacgcccagcctattttttattttttgaggcagagtctcactctgtcacccaggctggagtgcagtggtgcaatctcagctcactgcaacctccgcctcctgggttcaggtgattctcctgccttagcctcctgagcacctgggactacaggcgcctgccaccacacctggctaattcttatatttttagtagaggcggggtttcaccatgttggccaggctggtctcgaactcctgatctcaagtgatcaacctgccttggcctcccaaagtgctggaattacagccatgagccaccatgcccagccaaatcatgagatttcaataccgctgaactttgattatggcaaagtgaacttctgctttgattaaagcttgatgagagaggtggctggggatagtttgagataagggcaaggcaggaaaatgcataatcttacgtgggctcattgtcattgtacaattcttttggtccatgtggaatttgatccgtcctatgacttaagttatgtttatttttgtttttatttttatttattttgtgtctttttgagagacatgatgttgctctgtcacctgggccagaatacagtggcacaatcttagctccgtgtagccttgaactcctgggctcaagtgatcctcccacctcagcccctcaaacagttgagattatagtatgaaccactgtgcctagccttaagtgatttttaaatttgtactgaacagtttgtcctttccttccattaaatcatattagaagtacagaacttgatatttcctgtagcaatacagtttttctttgatgaagtttgatttcaagtacttatttttcataatttaaagctattttttatagagagaattttaatcaaatatttggatgtcactattgctatatatggtattaagtatggtgaccatagtttgtaaactccaaactgacagcaagacaggaaatttgtgttagcaaaggcttttttcttactgtttgaattttttaaaaattagatacaatacagagaggagcacacaaatcattaagagtacagctcagcgaattttcacacagtgaacatgtgtaaacagcaagtaacaaaagatttacctgcatcctataacctcccattattcccttttctaggtactgtctctccactgcattcccaccaaatataaccactatgctgaattctgacatcataaatgagttttgcctgattttgagcttttgtgactggaagtgtacagtgtatataccctttcgattctgtcctctttagtttaccattgtttgagaaatttatccatactgttccagaattaactactgttaattattgttaattaactactgttgtagttaattcatcctcattgttatctagtattcttttgtgagtaaacacaatttccattctactgtgatcccagctatccatttgggtcgtttccagtttggggtccattacaaatagtaatgctatctgtaatgctattttgtattactacaaatagtaatgctatttgtggcacaaaaatactgcttttgtgaacattcttatacatgtcttttgatgaatgtatgtttgcattgctgttgtttacattatgtacctagtaatggaattgctagatcataggagatgtatatattaagctttagtggatgcattacataattattagttattattggttataccaatttatcctctcatcagtagtatacaacagtttctgtatctctaatctccaacattttagccattttagagtttgtgtactaacacattgtggttttaatttacatttccctgatgactaataaagttgagtacctcttttgtgttctttatagccatttgactgtcttgtgaagtgcttgtttgtcttgcctatttttcttttctttctttctttttcttccttccttcctttctttctttcttctttctttccttccttcttttctttctttctgtctttctttcttgtctttcttgtctttctgtctttcttggtcttgccctgtcacccatgctggagtgcagtggtgcagtctcagcttactgtagcctcgacctttttggggctcaagttatcctcctttctcagcctcccaagaagctggactacaagcacgcaccaccatgctcagttaattttttattttttgtagaaatggggtttcaccatgttgtccaggctggtctcaaacttctgggctcaagtaatcctcctgccttggcctcccaaaatgctgggattacaggcatgagccaccgcagccagccttggctatttttcaaaaggatataagtagaacatctgtatatcccttcaatttgcatattattcagtaagagttgcactctggtagtagaaatatataaggaggagaaagaagtggaaacaaaaagtctattctcatgagaagacttgggggatagtgttctctctagctccaagctacttattccttacgaaaagttgaagataaacttatctcagactgaggctgtctcaatgttgtcttcctattccattatacacatataacccatatttttttcaccagctgaattttgctcctagaaaattgattcatcaggaaaaatatccgtcttgcaaggtggttctctttagagtctgctgtgtgacatagctcaggacaaattgtgtgatgtcagataggttgggttaaggaatagaccttattggggaaagagagaacttggagggccaaggttagcaggagaaggaaatgttctctcatctgccgtcaattcagggaggggcaaacctggtgtctgtgttcacagggagggatccatccatctgtgattctcccttcttatcaggtagcatgggaaagctacactgttgcggggaggagggtcacacgcaggctacttagtaccaggcaccctggacttggattcaggttgccagttgtgtgagaaactgcccagcacctgaaggccctgaacccatgagaagttgtacctacctcccatgaggaggaatcctgtcatcccatgggagctgagcttgggtgcagtccctcttgctggcttgtccaggagtgagctccagggttgtttgggacagttctgctcattgctttacactgtgtatacattatctgtagagttccatgaagagaacttcagcactgtaactgcaagttttaacatggaacagaatttttctcacctgtattaattcttaagatttgaagttctatcaacaagcatttagattgtgtggagatttttttatttttatttttggagacagagtcttgctctgttacccagactggagtggcagtggcatggtcttggctcactgcaggctctacttcctgggttcaagcgattctcatgcctcagtgtcctgattagctaggactacaggtacacaccaccatgctggctaatttttgtatttttagtagagacgaggtttcaccgtattggtcaggctggtctcgaactcccagcctcaagcagtccacccacctcggcctcccaaactgctgggattacaggtgtgagccaccatgcttgactgacatcatcatgttaaaagaataaatgttctagggagctgggcacagtgtcatgtttctgtagttctagctgctcgggaggctgaggcaggaagatcccttgagccctggagttcaagtccagcctgggcaacatagtgagatctctttttttaaataaataaataactgttctagggactaaaatttcctttcaccattagtaatttactgtagaatctccaagaatgaacttattttaggtactgaaaatgagggagactaaatgttttatacagtagtttttagtaaaatatgagatttgatgcatttgatagatgatgtttgtttaaaataattcttaaatttttgatcatgtaattatagtttcattaatggtagatttgtaaaataaatgttaccaaatgaaaatgcatgtacctatgttaattatccttatctaaagctgaaagttcagttcaactatgttaaaacatagtaggggcctggcagggtggctcttgcctgtaatcccagaacttagggaggccaaggtgggcagatcacgaggtcaggagatcgagaccatcctggctaacattgtgaaaccgtatcgctactaaaaatacaaaaaattagccgggcatggcggtgggcacctgtagtcgcagctacttggtaggctgaggcaggagaatggcgtgaactcaggaggcagagcttacagtgagccgagatcatgccactgcactccaggctgggtgacagagcaagactccatctcaaaaaaaaaaaaaaagttggccaggtgtggcggctcacacctgtaatcccagcacttttggaggccgaggcaggcggatcacaagatcaggagtttgagaccagcctggctaacagagtgaaaccctgtatatactaaaaatacaaaaattagccaggcatggtggtgcatgcctgtagtcccagctacttgagaggctgaggcaggagaatcacttgaacccgggaggcggaggttgtggtaagctgagattgctccactgcactccagcctggacaacagagcaagactctgtctcaaaaaaaaaaaaaattaatgattaaattatttaggggagccgggcgcagtggctcacgcctgtaatcccagcactttgggaggccaaggcgggcggatcacgaggtcaggagatcaagaccatcctggctaacacaggatgaaaccccgtctctactaaaaatacaaaaatttagccgggcgtggtggcgggtgcctgtagtaccagctactcgggaggctgaggcaggagaatggcatgaacccgggtggcggagcttgcagtgagccaagatagcgccactgcactccggcctgggtgaaagagtgagactccgtctcaaaaaaaaaaaaaaattatttaggggaagatactatacaattctgtttaacaagtcacattttaattttttcttttggaaatattagcaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggtactgattttaaactcactaagtcacatttcttttttttttttttttttgagacggagtctcgccctgttgcccatgctggagtgcaatggcgcgatctcggctcactgcaacctctgcctcccgggttcaagcgattctcctgcctcagcctcccaagtagctgggattacaggcacacggcactatgcccggctaattttttgtatctttgttagagatggggtttcaccatgttggtcaggttggtctcaaactcctgaccttatgatccacctgtcttggcctcccaaagtgctgggattataggtgtgagccaccacacccggcttacatttcttttaaaaatgtggataccatttagaaaaggatgggccattcttcctatagggatctgactggtgaattataactgtgctgttaactttggaaatgggaatgcacaagatattgttttaaatatgcacgctaatgacagtttgtatccttctttccccacccccacccttgcttcaactacctgtcaaaattaacagcagccttctggaaatatggatgacagtggttttttctctattcaggtaagtagtcacaagcatgtactatgtgttgcttacatcccaggcaccgtttcacagcctttcaatagtcactgtaacaaggcgaccttcggaagttcttctgtctacagagtatagattatactctagagtactagattttttttttcttgagacagagtctcgttctgtcacctaggctggagtgcagtggcgtgatcttggctcactgtagcctctgcctcccgggttcaagcgatcctcctgcctcagcctcccaagtagctgggattacaggcacccgccaccacaccagttaatatttgtatttttagtagagatagtggggtttcaccgtgttggccagtctggtctccaactcctgacctcagcctcccaaagtgctgggattacaggtgtgagccactgcacctggccaactagagtactagatttttatatagataaacatgaaaggattgtagaatcttcatattagagtggggcatttaaaaattccttcttgagaaagattaatttgcatctggatgctaataataaccttaattctggccgggcgcggtggctcacacctgtaatcccagcactttggggaggccgaggtgggcggatcacgaggtcaggagattgagaccatcctggctaacatggtgaaaccccgtctctactaaaaatacaaaaattagctggacgtggtgacacgtgcctgtaatcccagctactcgggaggctgaggcaggagaatcgcttgaaccagggagtcgtaggttgcagtgagccaagatcgcgccactgcactctagcctggtgacagagcgagactccatctcaaagaaaaaaagaaatccttaattctaataagtcacaatgtctcaaacttaccatctgttgggtaaatttgagaaaatgcaataccttgctaccatccttttaaatcagcctaccagactggatttccttattatggtttgtggcttttgattttttttttttaatgtatagctctctttgaattctttggtggttatatatatatgtactcgcaagattcttttatctgtgggtctttcattctttttctaacactgtgagttgtatccagagtactttcggaacctctcctgagcgacctatctctgcagatatctttgtttatgtttcccttgtactgccctcctggactcttcctcatccaccagcatttccatctagtgctttaccgtgccactgctaacaggtaatggctactgcagggctgaaatcagaggccagagtaggcccagcacttggcgtttcctatttgtgccttgctgctcttggtgcctgttcatgtgtgcccactaccttgcactcaatttctgtctttgctggtacctggctcacttgcttctttgttggctaccttggagggcagatagtgaattttcagaaatttccctttttttgtcagacagattgaaataaacaggtttgcattttgttttttctacaagcggcaagcccatgaccctagaagtctgacatctatggaaccttcagtttaaatgcccagggagaacttattttggtagatatgatttctgacattgcaggtagcaagttgaatataatttttctaaagtagcacccacagcagccaaattatcagatgtatatagtagactagttttaagaaaagcacttatgggtagaatatacatctggatttttgaggcagttttatttaggaattgtgtggttttctggaacatctcagagacctggtatgaaaagcactcttctaatatatatgtgtttttttttatggatttagtgatatatctatacacacacactttttaaaacctatagccggctgggcgtggtggctcatgcctgtaatcccagtactttgggaggcccaggcgggtggatcacaaggtcaggagattgagaccagcctggccaacaaggtgaaaccctgtctctactaaaaatacaaaaatagctgggtgtggtggcgtgtgcttgtaatcccagctactcgggagcctcaggaggagaatcgcttgaacctgggaggcggaggttgcagcgagccgagatcgtgccactatactccagcctgggcgacagagcaagactctgtcacaaaaaaaaaaaaaaaaacctatagccttctagagaaatttatatatgaagtacacaactaacatagctacacttcctaaatttggaatggagtggtttagcttatgaaaagttgctatttttcttaacaggttataagcaatgccttgaaagtttggggtttagaactaatcctgttcaacagtccagagtatcagaggctcaggatcgatcctatgtaagattctgttttgcatttcatacatttcttttcccaaatttgatttttaaagttgtaatttcttaaagaagagaaatacattttgaatacttttgttttgatgttccctgtttcattcactcagactttcctatttcacctttgtgatgtccatgagcatctgccctgtagccttcctggcaccccagtgtctgtggcagcacagagctgaccccataagtggtgcatgaggccatcttgtggcacagcatcactaagctgctgcagagacgttcatatggttgtgtgatcttttaaaaacatcagtgacacttaactataaatataatcttaaattatcacaaattttatataatatttgccagtagacaacataaatatgaattcaatatttcaagttaatattgtctgttttcttttttagaaatgaaagatcatttatatgcaattataaggaacactggtttacagttagaaaattaggaaaacaggtaacatttcttacccttccttgtctttttttcttatattgtaccccatttaaaactaaaatgtgggccaggtgtggtggctcatgccaacagtttgggaggctgaggtggggggatcacttgaagccaggagtttgagaccagcctgggcaacaaagggaggtcctgtctcttaaaaaaaaaataaaaataaaaataaaaataaataaaaaaaaaaacaaagagccaggcatggtggctcacatctgtaattccagcttacttggaaggctgagtcagaaggatcacttgagctcaggagtttgaggctgcagtgaactatgattttgtcactgtaccccagcctgggtgacagagtaagactgttctataaaacataaaaataaaaaaaatatatttaaaaattaaaaaaaaaaaaggattgctgactttaaaattaggaaactgaccagtaatgtgtgtgtgtgtagcatggtttatccttcttgatagatagaaattgtcattttaaaagataatatcagttttccttataaatttatttgtgacaagtatatgcaatttaactatatcataagaaaaattctatattaaagataatacaaatgtggttacttttaagtgggtttttatgtgatgactatgttctgtcagttaattattacatttatagatttgtatttagcatagtgctgtcacaaagcctgaaatagtgtcaagcatgaataaagcattcaattatgtttgctttagtgtaagattattcattatgattccaaaagccatgtaatacgtacgtctacagaaaatcacttctattttttaaataaaacatgaaatatgtcttgagcaagctattttaagaaacaatcatttaacgtccttgttattagaattttgaatctttgaaagagggttattgaaaaccagctaggacagtaaaaaagaataaactagtgatacatgcagcaatatggatgaatctcaaaataattatgctgaaagaataacccacaaacaaaatactacctgctgtatggtatcatttattaaaagtctagaaaagtgcagattcatctgtagtgatggaaagcagattgaccagcggttgcctggggacgagaaggctatggaggagtgagaggggagggttacagagaggcacgggaaacatggcaatgaggaatgtgttcactatcttggttgtagtaatggtttcatgggagtacagtatacaaatgtgaaaacatttcagaggccagatgcagtggctcatgcctgtaatcccagcacttttggaggccaaggcaggaggattgcttgagctcaaggagttcaggaccagcctgggcaatggcacaagaccccatctctaaaaaaaaaatgaaagaaaaaaaaattggctaggcgtggtgatgcatggccgtagtcccaggtgctagggaggctgaggagggagcacagaggtcaagcctgcagtgaatcatgatcgtgctactgcactccagcttgggtgacagaaggagatcctgtctcaaaaaaaaagtttcaaattatacactttaaatatgtgcagtttattatatgtcacttataccccaataaatctgttttttttaaaatgtaaatacaagccaaaaaaggtataagtcaagaaaatatattgaattaaatctgtaagagataattcaaaaacaaaaaccctattgttatcttttaagtcacccaaatcaaatttgggaaaagtcacctacttagcttcatcctaagttggttctttctttctttctttccttcttttgagacggattcttgctctatcgcccaggctggattgcagtggcgggatcttggctccctgcaacctccgccacctgggttcaagcaattctcttgtctcagcctcccaaatagctgtgtctacagccacgcaccaccacacccagctaatttttgtatttttagtagagacggggtttcgccatgttggtcaggctggtcttgaactcctgacctcaggtgatccgtccgtctctgcctctcaaagtgctggggttacaggcgtgagccaccatgccgagccctaagttggttctttcttaaagttcttcctgaggagccaagagcaagttaaggagatgtaacctagaagcttacagtggaggctagctgggtgcagtggttcacgcctgtaatcccagcactttaggaggctgaggcagggagatcactgaggccaggagcttgagagcagcttggcccaacacagtgacaccttgtctctacaaaaaaaaaaaaaaaaaaaggcagcttacagcagtagaggctgatgcgagtgggaatcacctctaggtaaaaaccagtgtagcgtactgctgagattatttaacctctgggttttatttatgtgtttttaaaaattatgatccagtattttttacttttttttgtataaagtaagcactgaatttttaaggttgtattaatttgcaaataaatgtctatcttattattttgagagatttaaaaaattttagttcttcaaaattgcattttcacattttgaattacgttatctttgacaaatacagaagatgtcaaattttggtttattttctttggttctaatttatatttttgtttaaaactatatttttcactatagactctttctgtctctcgaggtccctgtataatgaaaaagaaggctggaaaaagtattaacattgtcaaaatccaggaaaagtagttggtcatgatattgatcgttaactttagaaactttttgtatcttgtgggttaaattaggattactatgtggtagtgataaatgatgttaattagggccgagtgcagtggctaacacctgtaattccagcatgtagggaggctgaggtgggaggatgtcttgaatccaggagtttgagaccagcctgtacaacatagtgtaagaccccttctccacacaaaaaaattagaaaatttgtcaagcatcttggtgcacacctgtagtcccagctgcttgggaggatgaagcgagagaatcacttaagcccaggtgttcgaggctgcagtgagctatgattgcaccactgcactccagactagatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaacctcccaaagtgctcggattataggcatgagctgcatgcccagctaatttagtgatttttaaaaactgagctggtaattataaattctcttcctggaacttctgactttctcacaattggaatcttttgacaaaaattatcagtaatgggaaaactttgtgtagttgtcatttttcctcccatcagtgtgatagatatgattggagttatgttggactgatattttgaaaaaagatttaattatagctattaataaagacatttaaactactgactatgcatttttattcttttgggagggtttaatgtttatagtttaaagcaaactgttgtttttaaaaaagtatctaacagggccgggcgcggtggctcacacctgtaatcccagcactttgggaggcctaggcgggcggatcacaaggtcaagagatcaagaccatcctggctaacatggtgaaaccctgtctctactaaaaatacaaaaaaatagctgggtgtggcggcgtgcgcctgtagtcccagctactcgggaggctgaggcaggaggatggcatgaacccgggaggcggagcttgcagtgagccgagatcgcgccactgcactccagcctgggcgacagagcaatactctgtctaaaaaaaaaaaaaaaaaaaaaaaaagagtatttagcagaggccaggtgcagtggctcatgtttgtaatcccagaactttgggaggctgaggcgggcggatcatttgaggtcaggagtttgagaccagcctggccaatgtggcaaatgtgctgtctctaactaaaaatacaaaaattagctgggtgtggtggtgcagacctgtagtcccagctacttgggaggctgaggcaggagaatcacttgaacctgggaggcagaggttgcagtgatccgagatcatgccactgcactccagcctgggttacagagtgagactcttctcaaaaaaaaaaaaaagtatttaatagtgataaatctgcagtattctcttgtagtttttaagatcatattattcagtcaaagaaaagagctcaacttgaaatatttccagagtttaaacaatcttactaagctttgatgggttgtatctattcttaacatgtgaaacttccttattacctataatatacactaacttaaatattgacaatttttttccagtggtttaacttgaattctctcttgacgggtccagaattaatatcagatacatatcttgcacttttcttggctcaattacaacaggaaggtaagtaacggctgaacattttgtaatgttacctttcgaagtagttaaataaccaggcacattagatgacagtgtgataaaactgtttttctggcagtggcagtgaaacaatctttagttttgacgtggtgataggctgtgatttgggtgacgctgttcagttagagttctcactgacacctggcccttcctcttctgaggatgctgctttctttgcagcccttctaagtaatggctttttcttttatacatcacatatcacacggctgagaggagggatagatgtttttcttctttgcctcttctaggccactgttcttccttataaactccagtttctttgaaatacatgcccctaacggctgggcacggtggctcacgcctgtaatcccagcactttgggaggctgaggcaggcggatcacgatgtcaggagatcgagaccatcctggctaacacggtgaaatcctgtctctactaaaaataacaaaaaattagccggggtgtggtggcggacgcctgtagtccgagctactcgggaggctgaggcaggagaatggcgtgaacccaggaggcggagcttgcagtgagctgagatcgcgccactgccctccagcctgggcgacagagcgagactccgtctcaaaaaaaaaaagaaaagaaaaaaaaaagaaatacatgcccctagattaaactatcccttgtccttttgcactcatccacaagtctcttttcatcagtgattttaggatctgactcgttgtctttttctctacttcaactacttttatcattcttaattatttctgtatcgtcaatcaatccagtacctgcctcttagtttcaaaatcacttactcttgcttagctattaccagtaatcataaccactgtcaaatctcaattgcaagcatattactctttaactaccacctcctatctttaaaccatgttttgtctgtttttttattccagccattctttaaaccctactgtggggcccaagcatttcctttatacgcattcttcctttcttctactgcttattttctgtaatccgtcatcataatcactccattgcattcttcaacgtgtttcccctctctccctccatcatacttgaatgacaaaaatctcaaccctggttaaaccacatcttggccttgtccattcctgtaccagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgattctcttgccttagcctgttgagtagctgggactacaggcttgtgctaccacacctagctaaggttttactttaaatttattataatcacaaaattcagatgagcctttagtgctgtctgatatttctactatgttttcttagtgatgtaccaccctccaaggtgtttataaaaaattatgtaccactctccaagaagtttataaaaaataatgtgccaccctccaaggtgactaatttcacagcttatgtctttaaacctttaagcactttcctctcccttacacaccttccttgtggctttccgttacattctgctgagaacatagaagcaattaaaattatgttctttctaccagcaaatttatcaatttgcttatatcttcacctgtgctttgagcctatttaaatagatgaatggtcccctacctctaaccaaaaccagtccctcacttgtgggctggatcccagctcttctcacctactcaagatgttcctgctttcatctctccactctcttatataatcagttccccccccctttttttgtaatattcctataagcagtaaaataagctttttatttccattgattaaaaataaaaatcctctcttaattccatgaaactccagctgcctccccatttttattttttccttaggattgtctctagtgtgccttctccttttcttgaactctgcctcctgggttcaagcgattctcctgcctcaacctcccgagtagctgggattacaggcgtgcaccaccatgaccggctaattttttttttttttttttgagatggagtttccctcttgttgctccggctggagtgcaatggcgtgatctcggctcaccgtaacttctgcctcctgggttcaagcgattttcttgcctcagcctcccgagtagctggatttacaggcatgtgccaccatgcctggctaattttgtattttagtagagatggaaggggtttctccatgtttgttaggctggtctccaactcctgacctcaggtgagccgcccacctcggccccctaaagtgctgggattacaggcatgagccactgcgcctggccccggctaaattttttttttttttttttgtatttttagtagagacagggtttcaccatattggccaggttggtctcgaattcctggcctcgagtgatccacctgcctcagcctcccaaagtgctgggattacaggcgtgagtcaccttgcctagccatcttttagtaatggtatttggagatcacaatttgagtgctggcatgcttattgctgctgggtttgttatgtagttattgtgaattcacatttaggaatatagggtttttaattctttgattttagatacttgtatcttttttcttttatatttaaaaccttggttcctgatgatatcccttcttagaaaccctgtctacctttggccttcagcccaccatgctgtggttttcctaacttgctgcctgcacttttcagattcctttcatggatcttaaatatcatctgtaaataagatctatgtgtcaataattaccaaacttttatctttagtcttgacatctaccctgaacacctagctttgactaactcctagctttggcatctccacttggaaatccaaaaagtgtttcaaactgaacatgtctatgaaagacttatttttttctctctatccatgctatccatcaggttttccatttccataagggtgactcttgtactctggttcctatatattataccgacagagcagcccagagtgcttcttaaccagtgtaaggcctgttatgtcccaccctcactctttgtccttcagtggcttcccagcacacttagaataaaatctgaagtcttaggccgggcttggtggctcatgcctgcaatcccagcactttgggaggatgagggggcagatcacttgaggtcaggagttgatgagaccagcctggccaacatggtgaaaccctgtctctaccaaaaaatacaaaaattaactgggtgtggtgttgtgcacctgtagtcccagctactcgggaggctgagataggagaatcacttgaacccgggaggcagaggttacagcgagccaagatcataccactgcactccagcctgggtgacagaacgagactctcaaaaaaaaattaaaaaaaaaaaatatgtgaagtcttgaataaaacccaagatctttaccatggcccctgaacagggcagagtatccattcttcagacactcttcatagaataccatggtgagctggcatatttattatacaatacagaaacaattttactggcagaaaacacattaaaccgtctaaactctgaatacagttgtcctcataaaaaatgttcaacatactattttgaggttttccattaatagttcttataatctttgtcccattatgtgttaatccaacaaaggatatccaataacaaacaccaaagtttaagaaaaatgtgctaggcgcggtggctcacacctgtaatcccagcactttgggaggccgaggtgggcagatcacctgaggtcaggagttcgagaccagcccagccaacatggtgaaaccctgcctctcctaaaaatacaaacattaactgggtgtggtggtgggtgcctgtaatcccagctactcaggaggctgaggcaggagaatcgcttgaacctcctgggaggcagaggttgcagtgagctaatattgcaccactgcactccagcctgggtgacagagtgagactccatctcaaattaaaaaaaaaaaaaaattaatgatagagaaacttaaatcagttagattgttttaggtatagcccatccttggtttttgtgtgtagcatctagcttggggaaaccctggatttctggaatcatatttagacacagtcacactagactaatgtaattcttttgggatgcaaaccacacgtttgacaccttaaatagcttttaggtatttggcttcccagcccctatttttagttacaaggggtgtacatgtgtgggtcagggtgggggtagctctttccgcagatgattagttttagccatgttactagttattgcacacattatctgtgtcctcacagcagccctgtgagtaagtgtattagggttctctagagggacagaactaataaggtagatgtatatatgaagggtaatgtattaaggagtatcgactcgtatgatcacaaggtgaagtcccacaataggctctctgcaggctgaggaaccaggaagccagtccaagtcccaaaacctcaaaagtagggaagctgacagtgcagccttcagtctgtggcaaaaggcctgagagcccctggcaaaccactggtgtaagttcaagagtccaaaagatgaagaacttggagtctgatgtttgagggcaggaagcatccagcatgggagaaagatgaaggctcagcaagtctagtacttccacactcttatttctgcctgctttattctagctgagctggcagctgattagatggtgaccacccagtttgagggtgggtctacctctcccagttcactggcttaaatgttaatctcctttggcaacaccctcgcagacacacccagaaacaataatttgtagccttcaatccaatcaagttgataatattaaccatcacaggaaggtactagtatcatatgtttaacagtagaaaccaagacaaatgcagctaggaagtgggagaactgggatcagatgcaggcagtctgattctaaatcagttgctgttacccactctgacaacagtaagtgagtagcctgctcagtcaagtactatattagtagggccctttacagacatatttatttctcacagtcactcaatgagacggctcttccagtcttacaatggagaaagtgaggctcagagactttaagtaacttaccttagacgactttactagtaagtataagaatcattatttggactaaagtctttctgaatcctcagcttgtatttttttccagtgttctgtgctgcctttttatctactagtgttttacatcaattttgaatctctttactaactggttaggttgatttttgccttttttttttaggttattctatatttgtcgttaagggtgatctgccagattgcgaagctgaccaactcctgcagatgattagggtccaacagatgcatcgaccaaaacttattggagaagaattagcacaactaaaagagcaaaggtaaaaatgaggcctgcagtatggaatatatggtagtatttcattatgagaattaaattttcatgcttagattgaatatgtggtccttgtgttgttggcgactctattttggaccttatattttagtgaagtttattagtttaaacttgaatcaactctttgaaatacttaaatatattaacttagttagctggtatggtatattcctagcacttcgggaggctgaggcaggctgattgcttcaacccaggagttcgagaccagcctgggcaacatggcaaaacctcatctctacaaatagtacaaaaattagccagatgtggtggtgtatgcctatagtcccagctacttgggaggcagaggaagaaggatcacctgaaactggggaggtagagactacagtgagccataatcacactaccgcactccagcctggtcgagagagtcagaccctgtctcaaaaaaaaaaaaaaaaagaaacggaaaaaaaaaacttagttggattcaaattgcaacacaatcattatattactagagcttatttgccagaaaacattttaagttttgacttacttaaagcctttacattacaaatgcctttatgttatgtctaaaatagaagattggttgcagttattaccagtgcttttgttctttagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtaaagacattctgatgtgtgttgtattcattgctgaagaattgattccaattattcttagatttcatggaagttaatgtactcttagaggtgttttgacaattactgcagaagcaatagctatatagtgggctttccctttagatttcttataatggaaatcactttttacaacctatattttattaggagtagttatatttttactcctggttattttatttggtttcaacactgtactaacacaatagtaaattgtggttttaatctttgtgggtatcagttgacccttatccaaatcagctgttacataaatatgtgccattagacactatggaagggcctggacagggaatataaactgattttacaaaaacccaacatttattggctatgcaacttaaaccgtaagcccactttggtgggcccagttttttagtgatataaactatcaatagagaaaagcgaaaacatatcccctagacaatctaggcaaagaaaaatgttaagacatagctcaaagtagcttaattaaaagtttgaagtgggttttttgttttatttttttctaactcatatgtatttgcttctactttctaatgaaattatttatcagttgatttccttagatatctaaataaaattgaaatttcattaatgggaagattatttttatcctgaacttttcttgcctctatgcatgcctctgagtactccatatggtgtgcaatcccatttttgattaatagagtcctgctggattagcagggacagaaatcagctttagatttctttcttttttttttttctttctttttttttttttttttttttgagtcagagtctcactgtcgcccagcctggagtgcagtgatcttggctcactgcaacccctgcctccgaggttcaagcgattctcctgcctcagcctcctgagtagctgggactacaggcgcctaccaccacgcccagctaattttttgtacttttagtagagatagggttttgcccttttggccaggctggtcttgaactcctgacctcaggtgatccacctgccttggcctcccaaagtgctgggattacatgtgtgagccaccacgcccagccagaagagtagaatattcttaaagagaaaacgttttaaaggcttactcaaatgagtataaacaaacatattgttgcttgaattggtaaatacagtgattggtttttgttgtgttgtgttttgttttcaggtagttccagaaacatatctcaagatatgacacagacatcaggtacaaatcttacttcagaagagcttcggaagagacgagaagcctactttgaaaagtaaagtagttggtacaagttaaagtagcatgtttaatatttgctttggctattttgtctatttgtaaatggttactgcctgaatcctgtgaatatttgaatgtattttttaaaaatttacagcaaataggacgggcacggtggcttacgcctgtgatgctagcagtttgggaggccaaggcgggcagattgcctgaggtcaggagttcgagaccagcctgggcaacacagtgaaaccccatctctactaaaaatacaaaagaatcagctgggcatggaagcgtgcgcctgtagtcccagctgcttgggaggctgagccaggagaattgcttgaacccgggacgtggaggttgcagtgagccgagatcgcaccactgccctccagactgggtgacagagtgagactccgtctccaaaaatatatgtatatatatataaataaaaataaaaatttacggcaaataacatgaaacaaaaaaaccttgccccaatactggataaattttttaaactgagtgaaggaaaccttataaaatttcatttattaaaagaaaaatgaaattaggacaagacaagaagaatgccaattgatcctttggatgtacttcttgcttacctgattaaccctgcaaaattcctctaccaatcagtacgaaaaacagctttggaggtatgggagcgcattcccaaatagacgtggtagttcatttagctgctcatggccgcttcaggcagtcctgtaagcctgttagcatcaggggaatggatgcaaaccataaatctggatcaactcctaaaaccttaccttgtgcccagccttgtaagtgcttgctaaataggaattccaccatatgaaaatacattcttttcaagtaactatcattcagacttttgtcccccactttttttttttaaagaaaaataaaaggctgggcacggtggcttacgtctgtaatcccaccattttaggaggccaaggcaggtggatcacctgaggtcaggaattcaagaccagcctgaccaacatggtgaaacctcatctctactaaaaatacaaaaattagccgggcatggtggtgggtgcctgtaatcccagctacttgggaggctcagacaggagaatcgcttgaatctgggaggcagaagttgcagtgagctgagataacgccattgcactccagcctgggggacaagagcgagacttcgtctcaaaaaaaaagagaaagaaaacttcatgttaaagattacaagataaataatcagacccactgatcctaggtcagaaaacagagtcatagctcaatctgacttactatttgctgtatttcatccattctgagatgcacatagtttcacatttcaatgtctctgaaattgagaagcatcttacagtcataattgacagtatattagcagcacctataaatattggctcattttacatttgatggtataatgaagaaaatatttacctttttttctgttttgtttttaagtcacaactcagaagtagatgaaggaaaattctgatcagctgacatcctcttaatgtgagatatttctagtctttattcagtatagattaatggctaattatatgttaaatttcaaagtagtgcttattagtgctttttacttttaagtttcaaaattaacttttttattataataaactccaaatttatacaaaagtagaaaaactagcatactcctgtttatgacccagattcaacaaatactagcacacggccaatcttgcttttttttttttttttttttgagatggagtcttgctctgttgcccaggctggagtgcaatggcacaatttctgctcactgcaacctctgcctcctgagttcaagcgattctcccacttcagcctcccaagtagctgggattacaggtacacaccaccatgcctggctaattcttgtatttttagtagacacgggatttcaccatgtcgtccaggctggccttaaactcctgacctcaagtgatccacctgcctcggcctcccagagtgctgggattacaggcatgagccactgagcccggcccaatctcgttttataatactcccatctcccattctttccactgtcccacctgcaagtttggattattttgtaacaaatctcaatcatcatattattctataaccattttaatatgtgtctctaaaatatattagctttatttttaacatagttaaatgctattgtcataaaataataatcataataattaattgtaattctatatcatcaattatctagttaatgtaaaaaataaatctaaggccaggcgcggtggctcacacctgtaatcccagcactttgggaggctgaggtgggcagatcacctgagatcaggagttcaagaccagcctgaccaacatggagaaaccccatctctactaaaaatacaaaaaattagccaggcgtggtggcgcatgcttgtaatcccagctacttgagaggctgaggcaggagaatcacttgaacccgggaggcgaggttgcggtgagccgagatcgtgccattgcactctagcctgggcaaaaagagtgaaactccatctcaaataaataaataaataaataataaaaaataacttaaatctacttaattagaaaaactaacattctaaaaattttattttaagaaatatcaaaattggctgggcacggtggctcacgcctctaatccctgcactttggaaggctgaggtgggcggatcacctgaggtcaggagggtcaggagtacaagaccagcctggccaacatggcgaaaccctgtctccactaaaaatacaaaaattagccaggcatgatgatgggcacctgtaatcccagctactcaggaggctgagacagaagaatcgcttgaacccaggaggtagaggttgcagtgagctgagatcaccccactgcactccagcctgggtgacagagtgaaactccgcctcaaaaaaaaaaaaaagagaaaagaaatatagaaattaaagcatacatggccaggcgtagtggctcatgtctgtaatcccagcactttgggaggctgaggcaggcagatcacttgaggccatgagttcaagaccaacctggccaacatggcgaaagcctgtctctactaaaaatacaaaaaaattagttgggcatggtggtgcacacctgtaatcacagctactttggaggctgaggcaggagaatcgtttgaacccagaggtggaggttgcagtgagccgagattgtgccactgcactctatcctgggtgacagagcgagatactgtctcaaaaagaaaaaaaaaaggctgggcgcggtagttcatgcctgcaatcccagcactttgggaggccgaggcaggcagattacgaagtcaggagatggagaccatcctggctaatacagtgaaaccccgtctctactaaaaaatacacaaaaattagctgggtgtggtggcaggcacctgtagtcccagctactctggaggctgaggcaggagaatggcatgaacccgggaggtggagcttgcagtgagcagagatcacaccactgcactccagtctgggcgacagagcgaggctctgtctcaaaaaaaaaaaagaaagcatactctcacctccttcagtgactgatgttagtattttggcacattctttttctgtgacatatacacacttaccttgtaagtgttgtactcatttcctatgacagtaaatagtctttgtaacaggctgcatgatatttcataaaatgaatggatgtggcataatttatatgtgagccttttgaattctgctattataattaatattgcaatgaacaattcttatattgcctctacacctcaaatgtcttatcatttcttctagtttttctgaggatgtcagattattgggttaaaggatatgaacatttttaaggccttggaacagatttctaaattgctttccagaataattcccatgtgatactttcaccatgtttatttcagacttttttttttttttttttttgagacgaaatctcactctgtcacccaggctggagtgtagtggcatgatctcggctcactgcaacctccgcctcctgagtttaagcgattattctgcctcagcctcccaagtagctgcggttacaggcaagtgcctccatgcctggctaatttttgtgtcttttgtagacatggggtttcaccatgttgcccaggctggtttcgaactcctgagctcaggcaatctgcctacctcggcctcccaaagttctgggattacaggcgtgcaccaccgcgcccagccatcagagtcttttttgtcaaaataaaatggtctaaagacatacatcatagagaaactataatacaaaatttacaggtatatctaagaaaagaaaagtatatttaaagcataaaaataaactgctcttttacttaaaattttttaaaaactggattaaaaatatgaaacttccaacaaattgagcttttttttttttttttttcttttttgagacgaggtctcgcttttgtcacccagtctggagtgcagtggcgcgatctcggctcactgcaacctccacctccctggttcaagcaattcccctgcctcagcctcccaagtagctgggattacaggcgcatgccaccacgtcgggctaatttttttgtatttttagtagagagggggtttcaccatgttggccagactggtctcgaactcctgatctcaggcaatctgccagcctgggtctcccaacatgctgggattacaggcatgagccactgcactcggcctgaactttttatagtagtaacgataattcagtaatgtccaataatgactaagtaagttataacaagtacaatgtcagcaataactagtgctttttagtaaacagggtcaggcaaccttgtacccttttaaaaatgttcgaatatcgatatacctccttcctacttggtggaggattgattgaggaggaaagtgtgcagtgatggttaccagcttcagcctcttggcttgactttgcaaatactggtgagaatttggaaagagcttgagaatatcttacatagtcacatgttgctgagaagagttaagaactaacttcttgatgttcatttttaacaatggcttgcattcaaaaccttgtagagctcattagtaggagctaagaagctaatatttgcctttcactaaaattcctgattacttagcctaggtagttcgttgtctctctaggttctgtctttgggagcttgggtctaaggttatcaagctaactctttcttccctctcacccttcccaaattgaccctggtgctgatttgttattcatacgattttctagtttttcttttccctttttgagtatttgaagcttcatactgaatatagtaatcatagtattcatgcataaagaaaatcataaagtaattgcataaatgcataaagtaatcatagttttcatgcattaaaaaaactagttttggctgggcgctatggctcacgcttgtaatcccagcactttcggaggccaaggcaggcgaatcatctgaggtcaggagttcgagactagcctggccaacatggcgaaacctcttctctactaaaaatacaaaaaaattagccgagtatggtggcgggcgcctgtaatcctagctatttggcaggctgaggcaggagaatcacttgaacctgggaggcagaggttgcagtgagccgaggttgtgccattgcactacagcctaggcgacaagagcaagactccatctcaaaaaaaaaaaaaaaaaaaaaaaaactccctattacagattcataatttatgagtcattaaataatattttcaagccatgacattttttccagcagtagtctctaaatctgttttaccatcataaaaccccaagcaaaactctactacatcagctgtgtcactgtaaaacctgccttaactcacagaagcatgaaattaagcaatgtgtgtgaaactattttataaactgtaaagtattccatacatacatgttggcagttattaatgtcttctctaggtgtggctttgaaatggatgcagatgctttctgttacaaaaaacataagttgcaaatgttctataacaaggagagacacaaatatcttcatggacatggattgctatgagtgtttgattgcctaatacttgagccaccacttcagtgatatggtataatttatcaaacagtgttgagaaacagaaactactggggatgttttaaagaggaaaatacttaatatagaaattaggggtttacataatcttaagaaaggatgaaggtgcagctcttagccaggcctccacagtaccacaaaccaacttgcaggaagagctgtaaccactgccccagttgggacaatgggtaatgaggatattaaatttaagaacatactgctatagcaatgatccttggcatagaaagctgccaccacaattgcctagagatgggaacatgaagtctggcccccattgcaacagcagtgaagcagaattttgggactggcatctcccaaatggctttgcttgccaccagagaacaaccaaagtggagggagatggctaggcctcatttctgcctattttattttattttttgagacggagtcttgtctgtcgcccaggctggagtgcagtagtgtgatctcggctcactgcagcctccgcctcccagcttcaaacaattctcctgcctcagcctcctgagtagctgggattacaggcacccgccactgtgcccagccaattttcttatttttagtagaggtggggttttgccacgttggccaggctggtcttgaactcctgacctcaggtgatctgcccgcctcagcctcccaaagtgttgtgattacaggtatgagccaccatgcctggcccatttctcccttttttttttttttttttttttgaggtggagtctcactctgttgcccagactggagtgcagtggtgcaatcttggcgcattgcaacctctgcctcccagtttcaagcaattcttctgcttcagcctcctgagtagctgggactacaggtgtgtagcaccacacctggctaatttttgtttttgttttgttttttttgagacagagtctcactctgtcacccaggctggagtgtagtggcatgatctgggctcactacaacctccgcctcccgggttcaagcaattctcctgcctcagcctccagagtagctgggattacaggtgtgcgccaacacacctggctaatttttttgtatttttaatagagatggggtttcaccatgttggccaggctggtctcgaactcctgacctcgtgatccgcccgcctcggcctcccaaagtgctgggattacaggcatgagccaccgtgcccagacaaggtttgtatttttagtagagacagttttgccatgttggccaggctggtcttgaactcctcacctcaggtgatccgcctgccttggcctcccaaagtgctgggattacaggcgcaagccactgtgcctgacccgtttctgctttttaaagctcatgtgagcacttaatttgtaaccagaatcctacttgtaaaataatctaagacatgtagcttttagctttgtaacctctataatattgatggcacagtgggagtggatgctgagtaccacttgaacatgttccacctcagtgtcttcacagctggaaggtgtctacattgtttcaaggtggacaattgatttacttctcatttttcataaactaaaagtagaataaaggctattcctctaaaattgctatctcacctgtcactcccttgcattctcacataccttcttgagtggaggggcagagggcatggagtgatagcagatgtgccaggaattctccataactcagtccgtccctcttgtgctatgttgcagcatcaggatttgctaatgggaggatactgcccttacgtgcatcattagccatgcacactaaggtcttacacctacacacaggtcagtattctggctcagagaccaacagggagaaattgcagttctcattagttgaactttctttattgttcacagttttaaaacacaaaattgagaggaactctataaaaaatgtgccattctattaataattgttgctggtaatttaaaaatccttgttccttttcaaattcttatataccttttttttttaaacacttgatcttagccaaaagaccgagaagcaatcttttttttttttttttttttttttaacctatagcttctcactgagattgtcagctgtttgtaagttttggtttttggttttctgtgtttgtatttacatatatgaaatacagattgagtatcccttatccaaaatgcttaagactggaagtgttttagatttggggttttttaggatttgtgaatatttgcactatacttaccagttaagcattccaaatccaaaatttcaaatctgaagtgttccactgagcacctcttttgagtatcatgttggtgctcaaaaagtttctgattttggagcatttggatttctgattctcggatttaggatgcttgacctgtaatttcagatttacataaaagcagaaatagtacacagagctccttatatccttcacccagattccccaattattggcctttctgaaccatttgggaataatatgcagatatgattttccattatgtctcagttgttcagtgtatattttctaagtacaagaatatattcctacatatttacatgataaccgtcatgtttaaacattttaaaatggggatttgtattacattgtttctctttttgaaaaaattacagaggagcttaatgcaatcagtattacttaaaatctgataatgtgtgttaaatagtagttttcatttatttcatttatcaggtgttcagtgaatgcttactatgtaacagcacagttatcagcactggggaaatagatgagtaagataagatttgcactttcattagcttacatgccataaagagggaaataaagagaacaccagatgatgataagtttatgctgagaattaaaatgaagtgatgaaataatgggaatgtcaggtggctacttttggtgggatggtcaggaaaggcatctctggggagataaattttaagctcagacctgagtgaaaagaatgagccagccatggaaacattatgttaactcacatggtagtttgaaatgctttatctgatcaaaggtacttatttttggtgactttcaacaatattaagggtctataaaccaacactcatttgcataagaataactaccagtgaatctttttgtatgataggttttttgtttgttgtttttttgagacagagtctcgctctgtcgcccaggctggagtgcagtggcgcgatcttggctcactgcaacctctacctccccggttcaagtgattctcctgcctcagcctcccaaagtagctgggattacaggtgcctgccaccacgcctggctaatttttgtatttttagtagagatggggtttcaccgtgttgtccaggctcgtgtcaaacttctgacctcaagccatccacccgcctcggcctcccaaagtgctgggattacaggtgtgagccaccactcctggccatgataggttattttgtgatgaaaatacctacctcttaatttgtctgataaatttaaattttatgtctagatttcctaagatcagcacttccatattttaaagtaatctgtatcagactaactgctcttgcattcttttaataccagtgactactttgattcgtgaaacaatgtattttccttatgaatagtttttctcatggtgtatttattcttttaagttttgttttttaaatatacttcacttttgaatgtttcagacagcagcaaaagcagcaacagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagaatcttaagtaaatttgtaatctactaaatttccctggattaaggagcagttaccaaaagaaaaaaaaaaaaaaaagctagatgtggtggctcacatctgtaatcccagcactttgggaaaccaaggcaggagaggattgctagaacatttaatgaatactttaacataataatttaaacttcacagtaatttgtacagtctccaaaaattccttagacatcatggatatttttctttttttgagatggagtcttgctctgtcacccaggctggagtgcagtgtcgcgatctcggctcactgcaagctctgcttcctgggttcatggcattctcctgcctcagcctcctgagtagctgggactacaggcgcccgccacatcgcctggctaattttttgtatttttagtagagacagggtttcaccatgttagccaggatggtctcaatctcctgacctcatgatccgcccgcctcggcctcccaaagtgctgggattacaggcgtgagccatcacgtccggccagaaatcatgaatattagtaggtgaaaaataaacacattttaccacctggaaaatgaaaaatacttgagtataatctaaataacaatgggaagtgcagagttactttccaggtctcggtttaaatatgtcttaaactttggccaattagtagtagaagttgagagaaaaagtaactatctgacaaagaaattataagcagaatatataaagaactcttaaaactgaataatcagaaaacaactcaataaaaaggtgaaggatttgaaaagatatttcaccaaataagacatagggatgacaaataagcacatgaaaagactctcagcatcactagtcacagggaaatgcacgataaaaccacagtgagacaccatggcacccctgtaggtatggctttaatgaagaaataaaactgacaataccaagtgttggcaaggatccaagcagctgagactcatatactgttaatgggaatgtaaaagtgtacagctttggaaaacagtttggcatttttttgataaatgtatacttagccatgtgatccagcagtcccaatcatgtatatataaccaaaagaaaagaaaacttaggttcacataaaaacttatatcaaatgcttatagctgaccaggcatggtggcccatgcctataatcccagcactttgggaggccgaggttggcagatacctgaagtcaagtgttcgagaccagcctggccaacatggcaaaaccctgtctctacttaaaatacaaaaattagccaggcgtgatggcaggcacctgtagtccagctattcaggaggctgaggcaggagaatcacgtgaacccgggaggcagaggttgcagtgagccgagatcgtgccactatactccagcctgggtgacagagcaaaactctgtctcaaaaaaaaaaaaaaaaaaaagggctggacacggtggcttacgcctgttatcccggcactttgggaggccaaggctgatggatcacctgaggtcaggagttcaagaccagcctggccaacatggtgaaaccccatctctactaaaaatacaaaaatttgctgggcatggtggtgggcacctgtaatcccaggaggctgaggcaggagaatcacttgaacccgggaggcggagattgcagtgagccaagattgtgccattgaactccagcctgggtgacaagaccaaaactccttctcaaaaaaaaaaaagattatagcatctttattcatcattgcccaaaattacaaactgcctaaatgtagaccttcatttagttaatgaatgcacaaactgtggtatatccaaacaattgaataaaaaaaggaatgaactggtacttttttctattcctcctgtttaagtacagccaaaacacctcaacatttgtataaaacatgagctgggctgggtgcggtggctcacacgtgtaatcccagcactttgggaggctgaggcgggtggatcacctaaggttgggagttcaagaccggtctgaccaacatggagaaaccctgtctcaactaaaaatacaagattagtcgggcatggtggcgcatgcctgtaatcccagcttcttgggaggctgaggcaggagaattgcttgatcccgggaagcgaaggttgcagtaagctgagattgcaccattgcactccagcctgggcaacaagagcaaaactctgtctcaaaaagaaaaaaaaaaccattcagctgaatctcaaaggcagagagaagacagactggctagggaccttggaaccagaggagcagtgtggtggggagtggactggattttctttttgcctcatttatcctggacttggtgctggagaagctatgggttcagaccaagagaaaaccccatgaaaagcctgctctctctagccaaaagaggcaacctagcaagataaaaacctttagataataagcacttgactccagtcaaacaaaacagaataaactggccccattcacccctgtcagcaaaggccaagtgggagccaagatatgtaccccaacctggaagtcataaggtacacttctcccctttcccagccaaggtggtgttagagaaggctgactggggagctgggattctcattccctccaggaggtgataacactcctttcacatggtgtcagtggtcacagggaggctgaacttccacccagtaatacataggcatctctctggctcctatatgggtgatgttggagaagaggccgagtagagaatccagactgttgctgacacccagcagtaacaaggacacctccacaatgtccgtggaggccatgtggagatcagtaacaaggcactgctctccctcccagtcagagagatgtcagtggaggactagggggctagaactcccatgtgcgttcagcagtaatccccatgaccgccactccttgacatcacaggccttgaagaaacctggactttcactcccctctggttgtagcgaggtggcactcccttttccctgttgccagtgctgtgtcagtggaggcttgctaaattggaagatgtaaataagattcacattctcataacataataccccaaattttcaggatttaattgaaaatcactaagctgggcatggtggctcacacctgtaatcccagcactttgggaggccaaggtgggccaaacacttaaggtcaggaattcaagaccagcctggccagcatggtgaaaccctgtctctactaaaaatacaaaaattagctgggcgtggtggcacatgcctgtaatcccagctactgggaaggctaaggcaggaaaatcactggaacctgggagacggaggttgcagtgatccaagatcgcactagtgtactgcagcctgggcaacagagcaagactccatctaaatttgtgtcaggattcccagaaggagatgagaaagggtggggctgaaaaaaattgaggaagaagtcatggctgaaaatttcccaaatttggcaaaagtcagaaacctacagattgaaaaagctgaatgaagctcaaatatgataaactcaaagaagttcacacagagacacatcacagtcagatttctgaacactgcagacaaaaaatgaagatctcgaaattagcaagaaatgaccttacctaagcaatttgaatgacagcagatttcccatcagagatcataaaggccagaaggaaggggtacatacaacattttttctagtgctgaaagacaaaaactctaggctgggcacggtggcacacacctgtaatcccagcacttttggaggctgaggcaggcagatcacctgaagtcaggagttcgagaccagcctggccaacatggggaaaccctgtctctactaaaaatacaaaaattagccaggtgtggtggcacgcacctataatcctagctacttgggaggctgaggcaggggaatcgcttgaacctgggaggcgacggttgcagtgagccaaggtcgcgccactgcactccagcctgggcagttgagcgagactccatctcaaaaaaaaaaaaattatccaggcttggtggtgggcgcctatagtcccagctacttgggaggctgaggcaagagaattggttgaacccaggaggtggaggttgcagtgagccaagctcatgccactgtactccagcctgggtgacagagcgagaccttgtctcaaaaaaaaaaaaaaaaaaaaaaaacaagaaaaaaactctaaacccagagttacatatccagtgaaatatccttcaggagtgaagggaaaattaacgatttgtcttcaggagacctaccctaaaagaatggctaaaggaatttctctaaacagaaaagaaatgataaaagaagtaattttggaacatcaggaaggaagaaagaacaataaaaagagtaaaatatgggtaaacacaatagactttcccctccttttgaattttctaaattgtatgatggttgaagcaagaattatagcactgatttggttttcagtatatatattggaaatatttaaggcattatgttacagatgaaggagggtcaaaggatataaagggaggtaacctttctatatttcttttgtactgatgcaggcactttggaaaataatttcactatttgtttaaaaactgaacataccctgaccatatgacatagcatctatactcctgggcatttatcccagagaaacagaaatttatttattttttttttagtattacactccgtaagtgctgtaatactagcacttagggaggctgaggcaagcagattgcttgagcccaggagttcaagaccagcctgggcaatgctgcacagtcaaaaaagaaaaacaaacatttagaaaactattttaaaagtctttaattgctgaatgcctctttggctaatatttggaagatcattattattatttttcttttttaggcagagtcttgctctgtcactgaggctggagtgcagtggcgccatctcggcttactgcaacctctgcctcccgggttcacgccattctcctgcctcagcctcccgagtagctgggactacaggcgtgtgccaccatgcccggctaattttttgtgtttttagtagagatggggtttcactatgttagtcaggatggtctccatctcctaacctcgtgatccgcccacctcggcttcccaaaatgctgggattacaggcgtgagccactgtgcccagcctggaagatcattatttagtcctacaactgacacattgttccactgacgcaattgcccaggctggtcttgaactcctgggctcaagcaatctgcctgcctcggcctccctaagtgctagtattacaggcttgagccactgtgcccagccaaaaatagaaatttatattctcacaaaaacatgtacatgaatgtttatagcagctttacttgtcataatcaaaaactggaaacaaccaaaatgtcctacagtgaaacaaactgtagtacatccatagcatgtaatactctactgtcaggattaaaaagaaacccactgttggcacaggcagcaccgtggctggatctcaggggcattatgctgagtgcaaaaaagcctcaaagggtcttacactgtatgattccacttgttcaactaaaaatgacagctgtatagagatagagaacatattagtggtttccactagttagagaaagtgggtaaaagataggtgggtgggaatataaatcgatagcagggagatctttgtggtattataacacttctatgtcttgattgtagtggtggtggttacatgaatacacgtgtgataaaatgccatgtagaactacatataacgttgtgccaatgtcaatatctaggttttagtttgatctttagttacataagatgtaactattgggtgaaattgggcaaaagagtacacgaaacctctcttaaatatctttacaacttcctttgaattgacagtttttcaaaatagaaagttgggtttttgtaaatacatgaattgttgatatacacaacaaatctcaaatgcattatgctacgtgaaagaagccatattcaaaaggctacatacctactgatgccttttatatgacgtgcaggaaaagataaaactgtaggacagagaatatactggtggctatctgggattaggaaatggggatcgaccacaaaggggcagcatgggggaattttctggggcaatggaatggttgtgtatcttgatggtgtatttgtcaaaatatatagaactataaaagtaaattttgctttatatgtattaaatcaaaaaaagaaactcgtgctcaaatagaaatacattttctgagaacttgccttttgatgactttgagaattttctggaaattttaaagaaatgtggttttgtttcccaacaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcagaagcaggaggattgcttgagcctaggagttcgaggctgcagtgagctatgatcctgccactgaattctagcctgggcgacaaaacaggaaaaaagtatggatggaggaccagcagcatctgtatcacctgtgagtctttcagaaatgcagagtttcaggctacactcggacctactgaatcagaacttgcactttttacaagatccccaggacactaaagtatagagtgaagcttgagaagcgctgttgtgtggattgttcttaaccagctgcagtgatgaatatgaataacgcaggccagcacagtccattgatattctattccagcttactgcctgccaaaaggtccattattactggatcctcagtcttttccaagagaagctaagaattccaaatttttatttgaaatatattttttaaatgtttgttcaactggcccagtgccagtggctcatgcctttaatcctagcactttgagaggccgaggtggaaggatcacttgaccccaggagtttgagaccagcctgggcaacataaagagaccccatctctattaaaaaaaaatagagacaatgctgccttaaaaaagtcaaataaatgtttgctcaactgatttttaatactgagggccaaacaaagcacatcaaatttttaagtgctgcttttcctcattttatccaactctggacaccagaatccaaatgtagtgattggaatccacctagactgattgaggaatatattgtcctcaaattttatgagggttgactattcattttaactttaatt

SEQ ID NO: 3 - RNA, 6438 nt, Homo sapiens
  source 1..6438: mol_type = mRNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 4 - RNA, 6878 nt, Homo sapiens
  source 1..6878: mol_type = mRNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 5 - RNA, 6713 nt, Homo sapiens
  source 1..6713: mol_type = mRNA
gagaggggcagggggcggagctggagggggtggttcggcgtgggggccgttggctccagacaaataaacatggagtccatcttccacgagaaagttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 6 - RNA, 6672 nt, Homo sapiens
  source 1..6672: mol_type = other RNA
gagaggggcagggggcggagctggagggggtggttcggcgtgggggccgttggctccagacaaataaacatggagtccatcttccacgagaaacagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 7 - RNA, 6627 nt, Homo sapiens
  source 1..6627: mol_type = mRNA
gagaggggcagggggcggagctggagggggtggttcggcgtgggggccgttggctccagacaaataaacatggagtccatcttccacgagaaaaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 8 - RNA, 6684 nt, Homo sapiens
  source 1..6684: mol_type = other RNA
gagaggggcagggggcggagctggagggggtggttcggcgtgggggccgttggctccagacaaataaacatggagtccatcttccacgagaaacagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaagtaaagtagttgacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 9 - RNA, 6560 nt, Homo sapiens
  source 1..6560: mol_type = mRNA
gagaggggcagggggcggagctggagggggtggttcggcgtgggggccgttggctccagacaaataaacatggagtccatcttccacgagaaatggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 10 - RNA, 6835 nt, Homo sapiens
  source 1..6835: mol_type = other RNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcaggttataagcaatgccttgaaagtttggggtttagaactaatcctgttcaacagtccagagtatcagaggctcaggatcgatcctataaatgaaagatcatttatatgcaattataaggaacactggtttacagttagaaaattaggaaaacaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 11 - RNA, 6472 nt, Homo sapiens
  source 1..6472: mol_type = other RNA
gagaggggcagggggcggagctggagggggtggttcggcgtgggggccgttggctccagacaaataaacatggagtccatcttccacgagaaagttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 12 - RNA, 6814 nt, Homo sapiens
  source 1..6814: mol_type = other RNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 13 - RNA, 6838 nt, Homo sapiens
  source 1..6838: mol_type = other RNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagtggtttaacttgaattctctcttgacgggtccagaattaatatcagatacatatcttgcacttttcttggctcaattacaacaggaagtcactcaatgagacggctcttccagtcttacaatggagaaagtgaggctcagagactttaagtaacttaccttagacgactttactagtaaggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 14 - RNA, 6339 nt, Homo sapiens
  source 1..6339: mol_type = other RNA
gagaggggcagggggcggagctggagggggtggttcggcgtgggggccgttggctccagacaaataaacatggagtccatcttccacgagaaaagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 15 - RNA, 6075 nt, Homo sapiens
  source 1..6075: mol_type = mRNA
gagaggggcagggggcggagctggagggggtggttcggcgtgggggccgttggctccagacaaataaacatggagtccatcttccacgagaaaacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 16 - RNA, 6846 nt, Homo sapiens
  source 1..6846: mol_type = other RNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaaggttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaatcacaactcagaagtagatgaaggaaaattctgatcagctgacatcctcttaatacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 17 - RNA, 6982 nt, Homo sapiens
  source 1..6982: mol_type = other RNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagcagccttctggaaatatggatgacagtggttttttctctattcagaaatgaaagatcatttatatgcaattataaggaacactggtttacagttagaaaattaggaaaacagtggtttaacttgaattctctcttgacgggtccagaattaatatcagatacatatcttgcacttttcttggctcaattacaacaggaagtcactcaatgagacggctcttccagtcttacaatggagaaagtgaggctcagagactttaagtaacttaccttagacgactttactagtaagttattctatatttgtcgttaagggtgatctgccagattgcgaagctgaccaactcctgcagatgattagggtccaacagatgcatcgaccaaaacttattggagaagaattagcacaactaaaagagcaaagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtagttccagaaacatatctcaagatatgacacagacatcaggtacaaatcttacttcagaagagcttcggaagagacgagaagcctactttgaaaatcacaactcagaagtagatgaaggaaaattctgatcagctgacatcctcttaatacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 18 - RNA, 6120 nt, Homo sapiens
  source 1..6120: mol_type = mRNA
gagaggggcagggggcggagctggagggggtggttcggcgtgggggccgttggctccagacaaataaacatggagtccatcttccacgagaaacagccttctggaaatatggatgacagtggttttttctctattcagacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 19 - RNA, 6240 nt, Homo sapiens
  source 1..6240: mol_type = mRNA
gagaggggcagggggcggagctggagggggtggttcggcgtgggggccgttggctccagacaaataaacatggagtccatcttccacgagaaacaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacagacagcagcaaaagcagcaacagcagcagcagcagcagcagcagggggacctatcaggacagagttcacatccatgtgaaaggccagccaccagttcaggagcacttgggagtgatctaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttcta

SEQ ID NO: 20 - DNA, 24 bp, Synthetic construct
  source 1..24: mol_type = other DNA
tcaggacagagttcacatccatgt

SEQ ID NO: 21 - DNA, 27 bp, Synthetic construct
  source 1..27: mol_type = other DNA
ttcactcatagcatcacctagatcact

SEQ ID NO: 22 - DNA, 24 bp, Synthetic construct
  source 1..24: mol_type = other DNA
aaggccagccaccagttcaggagc

SEQ ID NO: 23 - DNA, 18 bp, Synthetic construct
  source 1..18: mol_type = other DNA
accccctccagctccgcc

SEQ ID NO: 24 - DNA, 18 bp, Synthetic construct
  source 1..18: mol_type = other DNA
gccaacggcccccacgcc

SEQ ID NO: 25 - DNA, 18 bp, Synthetic construct
  source 1..18: mol_type = other DNA
tctggagccaacggcccc

SEQ ID NO: 26 - DNA, 18 bp, Synthetic construct
  source 1..18: mol_type = other DNA
atttgtctggagccaacg

SEQ ID NO: 27 - DNA, 18 bp, Synthetic construct
  source 1..18: mol_type = other DNA
tgtttatttgtctggagc

SEQ ID NO: 28 - DNA, 18 bp, Synthetic construct
  source 1..18: mol_type = other DNA
actccatgtttatttgtc

SEQ ID NO: 29 - DNA, 18 bp, Synthetic construct
  source 1..18: mol_type = other DNA
gatggactccatgtttat

SEQ ID NO: 30 - DNA, 18 bp, Synthetic construct
  source 1..18: mol_type = other DNA
tggaagatggactccatg

SEQ ID NO: 31 - DNA, 18 bp, Synthetic construct
  source 1..18: mol_type = other DNA
gagccttcttgtttctcg

SEQ ID NO: 32 - DNA, 18 bp, Synthetic construct
  source 1..18: mol_type = other DNA
aaagtgagccttcttgtt

SEQ ID NO: 33 - DNA, 18 bp, Synthetic construct
  source 1..18: mol_type = other DNA
agcacaaagtgagccttc

SEQ ID NO: 34 - DNA, 18 bp, Synthetic construct
  source 1..18: mol_type = other DNA
ttgagcacaaagtgagcc

SEQ ID NO: 35 - DNA, 18 bp, Synthetic construct
  source 1..18: mol_type = other DNA
tgcaataagttattcagg

SEQ ID NO: 36 - DNA, 18 bp, Synthetic construct
  source 1..18: mol_type = other DNA
tccacagggctaaaatat

SEQ ID NO: 37 - DNA, 18 bp, Synthetic construct
  source 1..18: mol_type = other DNA
gctgatgtgcaattgagg

SEQ ID NO: 38 - DNA, 18 bp, Synthetic construct
  source 1..18: mol_type = other DNA
attctcatcctctcctcc

SEQ ID NO: 39 - DNA, 18 bp, Synthetic construct
  source 1..18: mol_type = other DNA
cactagtaactcctcctt

SEQ ID NO: 40 - DNA, 18 bp, Synthetic construct
  source 1..18: mol_type = other DNA
aaggctgctgtaaaaacg

SEQ ID NO: 41 - DNA, 18 bp, Synthetic construct
  source 1..18: mol_type = other DNA
cagaaggctgctgtaaaa

SEQ ID NO: 42 - DNA, 18 bp, Synthetic construct
  source 1..18: mol_type = other DNA
atttccagaaggctgctg

SEQ ID NO: 43 - DNA, 18 bp, Synthetic construct
  source 1..18: mol_type = other DNA
tccatatttccagaaggc

SEQ ID NO: 44 - DNA, 18 bp, Synthetic construct
  source 1..18: mol_type = other DNA
tgtcatccatatttccag

SEQ ID NO: 45 - DNA, 18 bp, Synthetic construct
  source 1..18: mol_type = other DNA
accactgtcatccatatt

SEQ ID NO: 46 - DNA, 18 bp, Synthetic construct
  source 1..18: mol_type = other DNA
cttataacctgaatagag

SEQ ID NO: 47 - DNA, 18 bp, Synthetic construct
  source 1..18: mol_type = other DNA
ctaaaccccaaactttca

SEQ ID NO: 48 - DNA, 18 bp, Synthetic construct
  source 1..18: mol_type = other DNA
tagttctaaaccccaaac

SEQ ID NO: 49 - DNA, 18 bp, Synthetic construct
  source 1..18: mol_type = other DNA
aggattagttctaaaccc

SEQ ID NO: 50 - DNA, 18 bp, Synthetic construct
  source 1..18: mol_type = other DNA
tgaacaggattagttcta

SEQ ID NO: 51 - DNA, 18 bp, Synthetic construct
  source 1..18: mol_type = other DNA
actgttgaacaggattag

SEQ ID NO: 52 - DNA, 18 bp, Synthetic construct
  source 1..18: mol_type = other DNA
tctggactgttgaacagg

SEQ ID NO: 53 - DNA, 18 bp, Synthetic construct
  source 1..18: mol_type = other DNA
atactctggactgttgaa

SEQ ID NO: 54 - DNA, 18 bp, Synthetic construct
  source 1..18: mol_type = other DNA
ataggatcgatcctgagc

SEQ ID NO: 55 - DNA, 18 bp, Synthetic construct
  source 1..18: mol_type = other DNA
ccttataattgcatataa

SEQ ID NO: 56 - DNA, 18 bp, Synthetic construct
  source 1..18: mol_type = other DNA
taactgtaaaccagtgtt

SEQ ID NO: 57 - DNA, 18 bp, Synthetic construct
  source 1..18: mol_type = other DNA
cctaattttctaactgta

SEQ ID NO: 58 - DNA, 18 bp, Synthetic construct
  source 1..18: mol_type = other DNA
tcctaattttctaactgt

SEQ ID NO: 59 - DNA, 18 bp, Synthetic construct
  source 1..18: mol_type = other DNA
attcaagttaaaccactg

SEQ ID NO: 60 - DNA, 18 bp, Synthetic construct
  source 1..18: mol_type = other DNA
agagaattcaagttaaac

SEQ ID NO: 61 - DNA, 18 bp, Synthetic construct
  source 1..18: mol_type = other DNA
aagagagaattcaagtta

SEQ ID NO: 62 - DNA, 18 bp, Synthetic construct
  source 1..18: mol_type = other DNA
taattctggacccgtcaa

SEQ ID NO: 63 - DNA, 18 bp, Synthetic construct
  source 1..18: mol_type = other DNA
gatattaattctggaccc

SEQ ID NO: 64 - DNA, 18 bp, Synthetic construct
  source 1..18: mol_type = other DNA
gtatctgatattaattct

SEQ ID NO: 65 - DNA, 18 bp, Synthetic construct
  source 1..18: mol_type = other DNA
gatatgtatctgatatta

SEQ ID NO: 66 - DNA, 18 bp, Synthetic construct
  source 1..18: mol_type = other DNA
taattgagccaagaaaag

SEQ ID NO: 67 - DNA, 18 bp, Synthetic construct
  source 1..18: mol_type = other DNA
aatatagaataaccttcc

SEQ ID NO: 68 - DNA, 18 bp, Synthetic construct
  source 1..18: mol_type = other DNA
caaatatagaataacctt

SEQ ID NO: 69 - DNA, 18 bp, Synthetic construct
  source 1..18: mol_type = other DNA
tggcagatcacccttaac

SEQ ID NO: 70 - DNA, 18 bp, Synthetic construct
  source 1..18: mol_type = other DNA
caatctggcagatcaccc

SEQ ID NO: 71 - DNA, 18 bp, Synthetic construct
  source 1..18: mol_type = other DNA
gcaatctggcagatcacc

SEQ ID NO: 72 - DNA, 18 bp, Synthetic construct
  source 1..18: mol_type = other DNA
atctgcaggagttggtca

SEQ ID NO: 73 - DNA, 18 bp, Synthetic construct
  source 1..18: mol_type = other DNA
gatgcatctgttggaccc

SEQ ID NO: 74 - DNA, 18 bp, Synthetic construct
  source 1..18: mol_type = other DNA
cgatgcatctgttggacc

SEQ ID NO: 75 - DNA, 18 bp, Synthetic construct
  source 1..18: mol_type = other DNA
ttggtcgatgcatctgtt

SEQ ID NO: 76 - DNA, 18 bp, Synthetic construct
  source 1..18: mol_type = other DNA
aagttttggtcgatgcat

SEQ ID NO: 77 - DNA, 18 bp, Synthetic construct
  source 1..18: mol_type = other DNA
ccaataagttttggtcga

SEQ ID NO: 78 - DNA, 18 bp, Synthetic construct
  source 1..18: mol_type = other DNA
attcttctccaataagtt

SEQ ID NO: 79 - DNA, 18 bp, Synthetic construct
  source 1..18: mol_type = other DNA
tctttgctcttttagttg

SEQ ID NO: 80 - DNA, 18 bp, Synthetic construct
  source 1..18: mol_type = other DNA
cgttccaggtctgtttta

SEQ ID NO: 81 - DNA, 18 bp, Synthetic construct
  source 1..18: mol_type = other DNA
gagccatcatttgcttct

SEQ ID NO: 82 - DNA, 18 bp, Synthetic construct
  source 1..18: mol_type = other DNA
aaatcctcctcatcttcg

SEQ ID NO: 83 - DNA, 18 bp, Synthetic construct
  source 1..18: mol_type = other DNA
gacttagtgccagagccc

SEQ ID NO: 84 - DNA, 18 bp, Synthetic construct
  source 1..18: mol_type = other DNA
ctcatcttccatgtcaat

SEQ ID NO: 85 - DNA, 18 bp, Synthetic construct
  source 1..18: mol_type = other DNA
atagccctgcggagatct

SEQ ID NO: 86 - DNA, 18 bp, Synthetic construct
  source 1..18: mol_type = other DNA
aactaccttgcatactta

SEQ ID NO: 87 - DNA, 18 bp, Synthetic construct
  source 1..18: mol_type = other DNA
ggaactaccttgcatact

SEQ ID NO: 88 - DNA, 18 bp, Synthetic construct
  source 1..18: mol_type = other DNA
catatcttgagatatgtt

SEQ ID NO: 89 - DNA, 18 bp, Synthetic construct
  source 1..18: mol_type = other DNA
agatttgtacctgatgtc

SEQ ID NO: 90 - DNA, 18 bp, Synthetic construct
  source 1..18: mol_type = other DNA
tcttccgaagctcttctg

SEQ ID NO: 91 - DNA, 18 bp, Synthetic construct
  source 1..18: mol_type = other DNA
ttcaaagtaggcttctcg

SEQ ID NO: 92 - DNA, 18 bp, Synthetic construct
  source 1..18: mol_type = other DNA
tttttcaaagtaggcttc

SEQ ID NO: 93 - DNA, 18 bp, Synthetic construct
  source 1..18: mol_type = other DNA
taggtccccctgctgctg

SEQ ID NO: 94 - DNA, 18 bp, Synthetic construct
  source 1..18: mol_type = other DNA
catggatgtgaactctgt

SEQ ID NO: 95 - DNA, 18 bp, Synthetic construct
  source 1..18: mol_type = other DNA
ctgaactggtggctggcc

SEQ ID NO: 96 - DNA, 18 bp, Synthetic construct
  source 1..18: mol_type = other DNA
acctagatcactcccaag

SEQ ID NO: 97 - DNA, 18 bp, Synthetic construct
  source 1..18: mol_type = other DNA
atgtcttcttcactcata

SEQ ID NO: 98 - DNA, 18 bp, Synthetic construct
  source 1..18: mol_type = other DNA
acatggtcacagctgcct

SEQ ID NO: 99 - DNA, 18 bp, Synthetic construct
  source 1..18: mol_type = other DNA
gacatggtcacagctgcc

SEQ ID NO: 100 - DNA, 18 bp, Synthetic construct
  source 1..18: mol_type = other DNA
ctaaagacatggtcacag

SEQ ID NO: 101 - DNA, 18 bp, Synthetic construct
  source 1..18: mol_type = other DNA
agtttctaaagacatggt

SEQ ID NO: 102 - DNA, 18 bp, Synthetic construct
  source 1..18: mol_type = other DNA
atcatttctgacagtttc

SEQ ID NO: 103 - DNA, 18 bp, Synthetic construct
  source 1..18: mol_type = other DNA
gaaagtatgaatatctaa

SEQ ID NO: 104 - DNA, 18 bp, Synthetic construct
  source 1..18: mol_type = other DNA
tgtaatcacacaggataa

SEQ ID NO: 105 - DNA, 18 bp, Synthetic construct
  source 1..18: mol_type = other DNA
cattaccaaagtggaccc

SEQ ID NO: 106 - DNA, 18 bp, Synthetic construct
  source 1..18: mol_type = other DNA
ctaaaagtcttatttcct

SEQ ID NO: 107 - DNA, 18 bp, Synthetic construct
  source 1..18: mol_type = other DNA
cactttcccatcattttg

SEQ ID NO: 108 - DNA, 18 bp, Synthetic construct
  source 1..18: mol_type = other DNA
gtcctacaaccgacgcat

SEQ ID NO: 109 - DNA, 18 bp, Synthetic construct
  source 1..18: mol_type = other DNA
ctaatatttggaagatca

SEQ ID NO: 110 - DNA, 18 bp, Synthetic construct
  source 1..18: mol_type = other DNA
ttaattgctgaatgcctc

SEQ ID NO: 111 - DNA, 18 bp, Synthetic construct
  source 1..18: mol_type = other DNA
ttgcacactcaaaaaaga

SEQ ID NO: 112 - DNA, 18 bp, Synthetic construct
  source 1..18: mol_type = other DNA
cctaactttagacatgtt

SEQ ID NO: 113 - DNA, 18 bp, Synthetic construct
  source 1..18: mol_type = other DNA
ctgcaaaaagatccaaga

SEQ ID NO: 114 - DNA, 18 bp, Synthetic construct
  source 1..18: mol_type = other DNA
gaggcgagagctaattag

SEQ ID NO: 115 - DNA, 18 bp, Synthetic construct
  source 1..18: mol_type = other DNA
tacctacaagacagaaaa

SEQ ID NO: 116 - DNA, 18 bp, Synthetic construct
  source 1..18: mol_type = other DNA
ctattacatgatgtgagc

SEQ ID NO: 117 - DNA, 18 bp, Synthetic construct
  source 1..18: mol_type = other DNA
tggttaataagaaatgaa

SEQ ID NO: 118 - DNA, 18 bp, Synthetic construct
  source 1..18: mol_type = other DNA
agatactttcctgaaagg

SEQ ID NO: 119 - DNA, 18 bp, Synthetic construct
  source 1..18: mol_type = other DNA
actattatcaacatcagg

SEQ ID NO: 120 - DNA, 18 bp, Synthetic construct
  source 1..18: mol_type = other DNA
ctgttcatccttctagaa

SEQ ID NO: 121 - DNA, 18 bp, Synthetic construct
  source 1..18: mol_type = other DNA
acggtatacagttgaagg

SEQ ID NO: 122 - DNA, 18 bp, Synthetic construct
  source 1..18: mol_type = other DNA
gatcagagaaaacaacac

SEQ ID NO: 123 - DNA, 18 bp, Synthetic construct
  source 1..18: mol_type = other DNA
gaaaaccaggtagcagaa

SEQ ID NO: 124 - DNA, 18 bp, Synthetic construct
  source 1..18: mol_type = other DNA
caaaagaattgtgggaaa

SEQ ID NO: 125 - DNA, 18 bp, Synthetic construct
  source 1..18: mol_type = other DNA
cctcagaaaagattacca

SEQ ID NO: 126 - DNA, 18 bp, Synthetic construct
  source 1..18: mol_type = other DNA
gaaataatgatcccatcg

SEQ ID NO: 127 - DNA, 18 bp, Synthetic construct
  source 1..18: mol_type = other DNA
gagtttaggaacgcacca

SEQ ID NO: 128 - DNA, 18 bp, Synthetic construct
  source 1..18: mol_type = other DNA
gtacttgtgcaaggctga

SEQ ID NO: 129 - DNA, 18 bp, Synthetic construct
  source 1..18: mol_type = other DNA
gcacatgctcacacattt

SEQ ID NO: 130 - DNA, 18 bp, Synthetic construct
  source 1..18: mol_type = other DNA
gacattcataaagcatct

SEQ ID NO: 131 - DNA, 18 bp, Synthetic construct
  source 1..18: mol_type = other DNA
taaggttttgatataagt

SEQ ID NO: 132 - DNA, 18 bp, Synthetic construct
  source 1..18: mol_type = other DNA
aaggcgcaggaagaaggg

SEQ ID NO: 133 - DNA, 18 bp, Synthetic construct
  source 1..18: mol_type = other DNA
tcaattggagaagaaagg

SEQ ID NO: 134 - DNA, 18 bp, Synthetic construct
  source 1..18: mol_type = other DNA
atactatgcttctcctag

SEQ ID NO: 135 - DNA, 18 bp, Synthetic construct
  source 1..18: mol_type = other DNA
ctaacagaaggagacttg

SEQ ID NO: 136 - DNA, 18 bp, Synthetic construct
  source 1..18: mol_type = other DNA
acattcatggtgggtacg

SEQ ID NO: 137 - DNA, 18 bp, Synthetic construct
  source 1..18: mol_type = other DNA
gaaggccaaatttcatgt

SEQ ID NO: 138 - DNA, 18 bp, Synthetic construct
  source 1..18: mol_type = other DNA
ctccagtcataggagaaa

SEQ ID NO: 139 - DNA, 18 bp, Synthetic construct
  source 1..18: mol_type = other DNA
actcaactgtaaagagaa

SEQ ID NO: 140 - DNA, 18 bp, Synthetic construct
  source 1..18: mol_type = other DNA
gaagcagacacctacatt

SEQ ID NO: 141 - DNA, 18 bp, Synthetic construct
  source 1..18: mol_type = other DNA
caagctatacctactaaa

SEQ ID NO: 142 - DNA, 18 bp, Synthetic construct
  source 1..18: mol_type = other DNA
atgttccagatcaccatc

SEQ ID NO: 143 - DNA, 18 bp, Synthetic construct
  source 1..18: mol_type = other DNA
cacagtataaatttaaac

SEQ ID NO: 144 - DNA, 18 bp, Synthetic construct
  source 1..18: mol_type = other DNA
taaacatgatgcaagtgt

SEQ ID NO: 145 - DNA, 18 bp, Synthetic construct
  source 1..18: mol_type = other DNA
acttccattgttcttaag

SEQ ID NO: 146 - DNA, 18 bp, Synthetic construct
  source 1..18: mol_type = other DNA
ttatagatccactaagta

SEQ ID NO: 147 - DNA, 18 bp, Synthetic construct
  source 1..18: mol_type = other DNA
atcaaaactatggacttt

SEQ ID NO: 148 - DNA, 18 bp, Synthetic construct
  source 1..18: mol_type = other DNA
tacatctcaattaaagag

SEQ ID NO: 149 - DNA, 18 bp, Synthetic construct
  source 1..18: mol_type = other DNA
ttgacccagcaagaaact

SEQ ID NO: 150 - DNA, 18 bp, Synthetic construct
  source 1..18: mol_type = other DNA
ttcaccaaaatgatacta

SEQ ID NO: 151 - DNA, 18 bp, Synthetic construct
  source 1..18: mol_type = other DNA
aacatcaatttcagagac

SEQ ID NO: 152 - DNA, 18 bp, Synthetic construct
  source 1..18: mol_type = other DNA
gatggagaatgagggata

SEQ ID NO: 153 - DNA, 18 bp, Synthetic construct
  source 1..18: mol_type = other DNA
caacattcaaaagagctt

SEQ ID NO: 154 - DNA, 18 bp, Synthetic construct
  source 1..18: mol_type = other DNA
tggattttagcttatgaa

SEQ ID NO: 155 - DNA, 18 bp, Synthetic construct
  source 1..18: mol_type = other DNA
cgaagttgtcagctgaaa

SEQ ID NO: 156 - DNA, 18 bp, Synthetic construct
  source 1..18: mol_type = other DNA
gcaatataccatattata

SEQ ID NO: 157 - DNA, 18 bp, Synthetic construct
  source 1..18: mol_type = other DNA
gtgtgcagccacacacca

SEQ ID NO: 158 - DNA, 18 bp, Synthetic construct
  source 1..18: mol_type = other DNA
aaaactttccctgataaa

SEQ ID NO: 159 - DNA, 18 bp, Synthetic construct
  source 1..18: mol_type = other DNA
caaaaaactttccctgat

SEQ ID NO: 160 - DNA, 18 bp, Synthetic construct
  source 1..18: mol_type = other DNA
ttagttagcaataaatcc

SEQ ID NO: 161 - DNA, 18 bp, Synthetic construct
  source 1..18: mol_type = other DNA
agctattttataatcata

SEQ ID NO: 162 - DNA, 18 bp, Synthetic construct
  source 1..18: mol_type = other DNA
aaaatctgttatatcgaa

SEQ ID NO: 163 - DNA, 18 bp, Synthetic construct
  source 1..18: mol_type = other DNA
attggcacaaaataatga

SEQ ID NO: 164 - DNA, 18 bp, Synthetic construct
  source 1..18: mol_type = other DNA
gtaagggaaacttcagaa

SEQ ID NO: 165 - DNA, 18 bp, Synthetic construct
  source 1..18: mol_type = other DNA
ttataattcttctgaaac

SEQ ID NO: 166 - DNA, 18 bp, Synthetic construct
  source 1..18: mol_type = other DNA
acatcccttgcagtttta

SEQ ID NO: 167 - DNA, 18 bp, Synthetic construct
  source 1..18: mol_type = other DNA
tgagggagtagtactaaa

SEQ ID NO: 168 - DNA, 18 bp, Synthetic construct
  source 1..18: mol_type = other DNA
gtcttaaaatatttagct

SEQ ID NO: 169 - DNA, 18 bp, Synthetic construct
  source 1..18: mol_type = other DNA
ggtaataattaacataaa

SEQ ID NO: 170 - DNA, 18 bp, Synthetic construct
  source 1..18: mol_type = other DNA
tccatggaaaatatgaca

SEQ ID NO: 171 - DNA, 18 bp, Synthetic construct
  source 1..18: mol_type = other DNA
tggaaaaaggtaatgaac

SEQ ID NO: 172 - DNA, 18 bp, Synthetic construct
  source 1..18: mol_type = other DNA
tgaaaagtttaatgtaac

SEQ ID NO: 173 - DNA, 18 bp, Synthetic construct
  source 1..18: mol_type = other DNA
ggtagctcatcaattcaa

SEQ ID NO: 174 - DNA, 18 bp, Synthetic construct
  source 1..18: mol_type = other DNA
gcatattggttttctcat

SEQ ID NO: 175 - DNA, 18 bp, synthetic construct
  source 1..18: mol_type = other DNA
actctaaagttaaaactt

SEQ ID NO: 176 - DNA, 18 bp, synthetic construct
  source 1..18: mol_type = other DNA
tataaactctaaagttaa

SEQ ID NO: 177 - DNA, 18 bp, synthetic construct
  source 1..18: mol_type = other DNA
tagggtatatatgaactt

SEQ ID NO: 178 - DNA, 18 bp, synthetic construct
  source 1..18: mol_type = other DNA
catattttcttaagtgct

SEQ ID NO: 179 - DNA, 18 bp, synthetic construct
  source 1..18: mol_type = other DNA
taggaactaaaagtcaaa

SEQ ID NO: 180 - DNA, 18 bp, synthetic construct
  source 1..18: mol_type = other DNA
ccaaacatgatgaaaccg

SEQ ID NO: 181 - DNA, 18 bp, Synthetic construct
  source 1..18: mol_type = other DNA
tctagctggccaggcgca

SEQ ID NO: 182 - DNA, 18 bp, Synthetic construct
  source 1..18: mol_type = other DNA
gctcagctctgctttaaa

SEQ ID NO: 183 - DNA, 18 bp, Synthetic construct
  source 1..18: mol_type = other DNA
acattcaaacgcatccag

SEQ ID NO: 184 - DNA, 18 bp, Synthetic construct
  source 1..18: mol_type = other DNA
atttcacaacaaactaca

SEQ ID NO: 185 - DNA, 18 bp, Synthetic construct
  source 1..18: mol_type = other DNA
ggatctgcctgctaaatg

SEQ ID NO: 186 - DNA, 18 bp, Synthetic construct
  source 1..18: mol_type = other DNA
gatgacagttcactagtg

SEQ ID NO: 187 - DNA, 18 bp, Synthetic construct
  source 1..18: mol_type = other DNA
taaatttaagccaacccc

SEQ ID NO: 188 - DNA, 18 bp, Synthetic construct
  source 1..18: mol_type = other DNA
caattaagaaatggaatc

SEQ ID NO: 189 - DNA, 18 bp, Synthetic construct
  source 1..18: mol_type = other DNA
gcatcttttcatactggc

SEQ ID NO: 190 - DNA, 18 bp, Synthetic construct
  source 1..18: mol_type = other DNA
ctggcatcttttcatact

SEQ ID NO: 191 - DNA, 18 bp, Synthetic construct
  source 1..18: mol_type = other DNA
ttttgatactatggttac

SEQ ID NO: 192 - DNA, 18 bp, Synthetic construct
  source 1..18: mol_type = other DNA
atagctttgaataatttt

SEQ ID NO: 193 - DNA, 18 bp, Synthetic construct
  source 1..18: mol_type = other DNA
tggcagtacctgatgtat

SEQ ID NO: 194 - DNA, 18 bp, Synthetic construct
  source 1..18: mol_type = other DNA
tcttgcaggtggtttaca

SEQ ID NO: 195 - DNA, 18 bp, Synthetic construct
  source 1..18: mol_type = other DNA
gtgaatttagttgttcct

SEQ ID NO: 196 - DNA, 18 bp, Synthetic construct
  source 1..18: mol_type = other DNA
cacttcttagcaggacag

SEQ ID NO: 197 - DNA, 18 bp, Synthetic construct
  source 1..18: mol_type = other DNA
ttcccaattagtaaaaca

SEQ ID NO: 198 - DNA, 18 bp, Synthetic construct
  source 1..18: mol_type = other DNA
ccaatagtttaaatatta

SEQ ID NO: 199 - DNA, 18 bp, Synthetic construct
  source 1..18: mol_type = other DNA
tacaaattatacattaga

SEQ ID NO: 200 - DNA, 18 bp, Synthetic construct
  source 1..18: mol_type = other DNA
ctgtacatacttgatccc

SEQ ID NO: 201 - DNA, 18 bp, Synthetic construct
  source 1..18: mol_type = other DNA
ttaaacttctactagcat

SEQ ID NO: 202 - DNA, 18 bp, Synthetic construct
  source 1..18: mol_type = other DNA
tatgaaagtggtatttcc

SEQ ID NO: 203 - DNA, 18 bp, Synthetic construct
  source 1..18: mol_type = other DNA
attaaatccatgacatct

SEQ ID NO: 204 - DNA, 18 bp, Synthetic construct
  source 1..18: mol_type = other DNA
gattaactattctgaatt

SEQ ID NO: 205 - DNA, 18 bp, Synthetic construct
  source 1..18: mol_type = other DNA
tagattgatggttttaga

SEQ ID NO: 206 - DNA, 18 bp, Synthetic construct
  source 1..18: mol_type = other DNA
ttacatgattaccgtaaa

SEQ ID NO: 207 - DNA, 18 bp, Synthetic construct
  source 1..18: mol_type = other DNA
aacagtttatattactga

SEQ ID NO: 208 - DNA, 18 bp, Synthetic construct
  source 1..18: mol_type = other DNA
gtttacctgcagcagcct

SEQ ID NO: 209 - DNA, 18 bp, Synthetic construct
  source 1..18: mol_type = other DNA
tttggccaagatcctagt

SEQ ID NO: 210 - DNA, 18 bp, Synthetic construct
  source 1..18: mol_type = other DNA
aatattctgtgaattgta

SEQ ID NO: 211 - DNA, 18 bp, Synthetic construct
  source 1..18: mol_type = other DNA
aaaaaaagcaccacctta

SEQ ID NO: 212 - DNA, 18 bp, Synthetic construct
  source 1..18: mol_type = other DNA
tcatgaataaagttaaga

SEQ ID NO: 213 - DNA, 18 bp, Synthetic construct
  source 1..18: mol_type = other DNA
gtttttttcctcatttac

SEQ ID NO: 214 - DNA, 18 bp, Synthetic construct
  source 1..18: mol_type = other DNA
caatgatactcaactggt

SEQ ID NO: 215 - DNA, 18 bp, Synthetic construct
  source 1..18: mol_type = other DNA
tggactactggtagtttt

SEQ ID NO: 216 - DNA, 18 bp, Synthetic construct
  source 1..18: mol_type = other DNA
tctgactgaaataaaatt

SEQ ID NO: 217 - DNA, 18 bp, Synthetic construct
  source 1..18: mol_type = other DNA
gacaatcaaaatgtgatt

SEQ ID NO: 218 - DNA, 18 bp, Synthetic construct
  source 1..18: mol_type = other DNA
cactagcatgattttaaa

SEQ ID NO: 219 - DNA, 18 bp, Synthetic construct
  source 1..18: mol_type = other DNA
tcctctgtcgccagggtt

SEQ ID NO: 220 - DNA, 18 bp, Synthetic construct
  source 1..18: mol_type = other DNA
cactagcatgattttttt

SEQ ID NO: 221 - DNA, 18 bp, Synthetic construct
  source 1..18: mol_type = other DNA
ttttaagaatttagtagc

SEQ ID NO: 222 - DNA, 18 bp, Synthetic construct
  source 1..18: mol_type = other DNA
tctgtacaggtccaatgg

SEQ ID NO: 223 - DNA, 18 bp, Synthetic construct
  source 1..18: mol_type = other DNA
ttatgcactgaatctatt

SEQ ID NO: 224 - DNA, 18 bp, Synthetic construct
  source 1..18: mol_type = other DNA
cgtaagaatttaaaacat

SEQ ID NO: 225 - DNA, 18 bp, Synthetic construct
  source 1..18: mol_type = other DNA
catcaatattaactattg

SEQ ID NO: 226 - DNA, 18 bp, Synthetic construct
  source 1..18: mol_type = other DNA
tgcgattcttagcctcct

SEQ ID NO: 227 - DNA, 18 bp, Synthetic construct
  source 1..18: mol_type = other DNA
cccttggcactctgcaac

SEQ ID NO: 228 - DNA, 18 bp, Synthetic construct
  source 1..18: mol_type = other DNA
tgtctcactctgttgggc

SEQ ID NO: 229 - DNA, 18 bp, Synthetic construct
  source 1..18: mol_type = other DNA
taggaagtcatatatata

SEQ ID NO: 230 - DNA, 18 bp, Synthetic construct
  source 1..18: mol_type = other DNA
cccgactgggataaagtt

SEQ ID NO: 231 - DNA, 18 bp, Synthetic construct
  source 1..18: mol_type = other DNA
tacctggcttaagttttg

SEQ ID NO: 232 - DNA, 18 bp, Synthetic construct
  source 1..18: mol_type = other DNA
acctttaagatggagttt

SEQ ID NO: 233 - DNA, 18 bp, Synthetic construct
  source 1..18: mol_type = other DNA
tccggattaaaaaaaaac

SEQ ID NO: 234 - DNA, 18 bp, Synthetic construct
  source 1..18: mol_type = other DNA
aaaatagcggcccaacgc

SEQ ID NO: 235 - DNA, 18 bp, Synthetic construct
  source 1..18: mol_type = other DNA
aacaaatattcgccaggt

SEQ ID NO: 236 - DNA, 18 bp, Synthetic construct
  source 1..18: mol_type = other DNA
tggcccaaggccgggtgt

SEQ ID NO: 237 - DNA, 18 bp, Synthetic construct
  source 1..18: mol_type = other DNA
caacaaacaattcacttt

SEQ ID NO: 238 - DNA, 18 bp, Synthetic construct
  source 1..18: mol_type = other DNA
tatccatacttaaggact

SEQ ID NO: 239 - DNA, 18 bp, Synthetic construct
  source 1..18: mol_type = other DNA
gttcttaattagggtcac

SEQ ID NO: 240 - DNA, 18 bp, Synthetic construct
  source 1..18: mol_type = other DNA
tgattagttgatccaatc

SEQ ID NO: 241 - DNA, 18 bp, Synthetic construct
  source 1..18: mol_type = other DNA
taaagttatttacattgc

SEQ ID NO: 242 - DNA, 18 bp, Synthetic construct
  source 1..18: mol_type = other DNA
gatgctggttataaaggg

SEQ ID NO: 243 - DNA, 18 bp, Synthetic construct
  source 1..18: mol_type = other DNA
gccaggtcattttttaaa

SEQ ID NO: 244 - DNA, 18 bp, Synthetic construct
  source 1..18: mol_type = other DNA
ttattatgtttaagacta

SEQ ID NO: 245 - DNA, 18 bp, Synthetic construct
  source 1..18: mol_type = other DNA
tcatgaaagcaaattaga

SEQ ID NO: 246 - DNA, 18 bp, Synthetic construct
  source 1..18: mol_type = other DNA
ccaacgatgtcaataatc

SEQ ID NO: 247 - DNA, 18 bp, Synthetic construct
  source 1..18: mol_type = other DNA
agaccacttggaaaaaat

SEQ ID NO: 248 - DNA, 18 bp, Synthetic construct
  source 1..18: mol_type = other DNA
ttagcactaattcttaaa

SEQ ID NO: 249 - DNA, 18 bp, Synthetic construct
  source 1..18: mol_type = other DNA
cgacaaatttagaagtta

SEQ ID NO: 250 - DNA, 18 bp, Synthetic construct
  source 1..18: mol_type = other DNA
tatgctattaaacatgcc

SEQ ID NO: 251 - DNA, 18 bp, Synthetic construct
  source 1..18: mol_type = other DNA
ccacaggcttaaaatgtt

SEQ ID NO: 252 - DNA, 18 bp, Synthetic construct
  source 1..18: mol_type = other DNA
ttctcattgctttgtcta

SEQ ID NO: 253 - DNA, 18 bp, Synthetic construct
  source 1..18: mol_type = other DNA
aggaatatccatttatat

SEQ ID NO: 254 - DNA, 18 bp, Synthetic construct
  source 1..18: mol_type = other DNA
attgagagcttcctaaat

SEQ ID NO: 255 - DNA, 18 bp, Synthetic construct
  source 1..18: mol_type = other DNA
ttccttgaactatgcaag

SEQ ID NO: 256 - DNA, 18 bp, Synthetic construct
  source 1..18: mol_type = other DNA
attagataatcacattta

SEQ ID NO: 257 - DNA, 18 bp, Synthetic construct
  source 1..18: mol_type = other DNA
cctaatagcccagtgttg

SEQ ID NO: 258 - DNA, 18 bp, Synthetic construct
  source 1..18: mol_type = other DNA
tatacagaacagtaattt

SEQ ID NO: 259 - DNA, 18 bp, Synthetic construct
  source 1..18: mol_type = other DNA
tctgtacttgaatttcaa

SEQ ID NO: 260 - DNA, 18 bp, Synthetic construct
  source 1..18: mol_type = other DNA
aaacaacaatgctttttg

SEQ ID NO: 261 - DNA, 18 bp, Synthetic construct
  source 1..18: mol_type = other DNA
cacagtgcacttgtatca

SEQ ID NO: 262 - DNA, 18 bp, Synthetic construct
  source 1..18: mol_type = other DNA
gggtcctgagcaagcggc

SEQ ID NO: 263 - DNA, 18 bp, Synthetic construct
  source 1..18: mol_type = other DNA
acacacagaagggctgca

SEQ ID NO: 264 - DNA, 18 bp, Synthetic construct
  source 1..18: mol_type = other DNA
gcaaatgaacttaacgag

SEQ ID NO: 265 - DNA, 18 bp, Synthetic construct
  source 1..18: mol_type = other DNA
gaaggcctgtgtgtgtaa

SEQ ID NO: 266 - DNA, 18 bp, Synthetic construct
  source 1..18: mol_type = other DNA
cggcttttctaacgacca

SEQ ID NO: 267 - DNA, 18 bp, Synthetic construct
  source 1..18: mol_type = other DNA
ctttggaagcccggcttt

SEQ ID NO: 268 - DNA, 18 bp, Synthetic construct
  source 1..18: mol_type = other DNA
tgttcaacagtgctttgg

SEQ ID NO: 269 - DNA, 18 bp, Synthetic construct
  source 1..18: mol_type = other DNA
tccacactaacaacagaa

SEQ ID NO: 270 - DNA, 18 bp, Synthetic construct
  source 1..18: mol_type = other DNA
aataatctttgatattta

SEQ ID NO: 271 - DNA, 18 bp, Synthetic construct
  source 1..18: mol_type = other DNA
gcattgcttataacctgt

SEQ ID NO: 272 - DNA, 18 bp, Synthetic construct
  source 1..18: mol_type = other DNA
acttttcaaagtaggctt

SEQ ID NO: 273 - DNA, 18 bp, Synthetic construct
  source 1..18: mol_type = other DNA
aactactttacttttcaa

SEQ ID NO: 274 - DNA, 18 bp, Synthetic construct
  source 1..18: mol_type = other DNA
tggaagagccgtctcatt

SEQ ID NO: 275 - DNA, 18 bp, Synthetic construct
  source 1..18: mol_type = other DNA
taaggtaagttacttaaa

SEQ ID NO: 276 - DNA, 18 bp, Synthetic construct
  source 1..18: mol_type = other DNA
cctttgctcttttagttg

SEQ ID NO: 277 - DNA, 18 bp, Synthetic construct
  source 1..18: mol_type = other DNA
ccttcatctacttctgag

SEQ ID NO: 278 - DNA, 18 bp, Synthetic construct
  source 1..18: mol_type = other DNA
gatgtcagctgatcagaa

SEQ ID NO: 279 - DNA, 18 bp, Synthetic construct
  source 1..18: mol_type = other DNA
aagaggatgtcagctgat

SEQ ID NO: 280 - DNA, 18 bp, Synthetic construct
  source 1..18: mol_type = other DNA
cgccgggcgagatcggca

SEQ ID NO: 281 - DNA, 18 bp, Synthetic construct
  source 1..18: mol_type = other DNA
cccgtaataaaaactctt

SEQ ID NO: 282 - DNA, 18 bp, Synthetic construct
  source 1..18: mol_type = other DNA
ctaaaaacaaagctggcc

SEQ ID NO: 283 - DNA, 18 bp, Synthetic construct
  source 1..18: mol_type = other DNA
atagcattactatttgta

SEQ ID NO: 284 - DNA, 18 bp, Synthetic construct
  source 1..18: mol_type = other DNA
cagatgttctacttatat

SEQ ID NO: 285 - DNA, 18 bp, Synthetic construct
  source 1..18: mol_type = other DNA
ttaacataggtacatgca

SEQ ID NO: 286 - DNA, 18 bp, Synthetic construct
  source 1..18: mol_type = other DNA
aagtgagccttcttgcta

SEQ ID NO: 287 - DNA, 18 bp, Synthetic construct
  source 1..18: mol_type = other DNA
aatcagtacctgtaaaaa

SEQ ID NO: 288 - DNA, 18 bp, Synthetic construct
  source 1..18: mol_type = other DNA
ttccagaaggctgctgtt

SEQ ID NO: 289 - DNA, 18 bp, Synthetic construct
  source 1..18: mol_type = other DNA
aaaggctgtgaaacggtg

SEQ ID NO: 290 - DNA, 18 bp, Synthetic construct
  source 1..18: mol_type = other DNA
aaaaatctagtactctag

SEQ ID NO: 291 - DNA, 18 bp, Synthetic construct
  source 1..18: mol_type = other DNA
agctggttttcaataacc

SEQ ID NO: 292 - DNA, 18 bp, Synthetic construct
  source 1..18: mol_type = other DNA
agaaagaaccaacttagg

SEQ ID NO: 293 - DNA, 18 bp, Synthetic construct
  source 1..18: mol_type = other DNA
atttaacccacaagatac

SEQ ID NO: 294 - DNA, 18 bp, Synthetic construct
  source 1..18: mol_type = other DNA
catgcagctcatgcctat

SEQ ID NO: 295 - DNA, 18 bp, Synthetic construct
  source 1..18: mol_type = other DNA
tcactaaattagctgggc

SEQ ID NO: 296 - DNA, 18 bp, Synthetic construct
  source 1..18: mol_type = other DNA
aagttagtgtatattata

SEQ ID NO: 297 - DNA, 18 bp, Synthetic construct
  source 1..18: mol_type = other DNA
tctcagcagaatgtaacg

SEQ ID NO: 298 - DNA, 18 bp, Synthetic construct
  source 1..18: mol_type = other DNA
aactagtaacatggctaa

SEQ ID NO: 299 - DNA, 18 bp, Synthetic construct
  source 1..18: mol_type = other DNA
atatagaataacctaaaa

SEQ ID NO: 300 - DNA, 18 bp, Synthetic construct
  source 1..18: mol_type = other DNA
aaggcatttgtaatgtaa

SEQ ID NO: 301 - DNA, 18 bp, Synthetic construct
  source 1..18: mol_type = other DNA
accaactactttactttt

SEQ ID NO: 302 - DNA, 18 bp, Synthetic construct
  source 1..18: mol_type = other DNA
tgcccgtcctatttgctg

SEQ ID NO: 303 - DNA, 18 bp, Synthetic construct
  source 1..18: mol_type = other DNA
gtcctaatttcatttttc

SEQ ID NO: 304 - DNA, 18 bp, Synthetic construct
  source 1..18: mol_type = other DNA
tgagttgtgacttaaaaa

SEQ ID NO: 305 - DNA, 18 bp, Synthetic construct
  source 1..18: mol_type = other DNA
cattaagaggatgtcagc

SEQ ID NO: 306 - DNA, 18 bp, Synthetic construct
  source 1..18: mol_type = other DNA
tctcacattaagaggatg

SEQ ID NO: 307 - DNA, 18 bp, Synthetic construct
  source 1..18: mol_type = other DNA
aaatatctcacattaaga

SEQ ID NO: 308 - DNA, 18 bp, Synthetic construct
  source 1..18: mol_type = other DNA
agccattaatctatactg

SEQ ID NO: 309 - DNA, 18 bp, Synthetic construct
  source 1..18: mol_type = other DNA
agatttgaaattttggat

SEQ ID NO: 310 - DNA, 18 bp, Synthetic construct
  source 1..18: mol_type = other DNA
aatgagtgttggtttata

SEQ ID NO: 311 - DNA, 18 bp, Synthetic construct
  source 1..18: mol_type = other DNA
tagaaaaaagtaccagtt

SEQ ID NO: 312 - DNA, 18 bp, Synthetic construct
  source 1..18: mol_type = other DNA
gcatcacctgttgggaaa

SEQ ID NO: 313 - DNA, 18 bp, Synthetic construct
  source 1..18: mol_type = other DNA
ctgtctgttttcctaatt

SEQ ID NO: 314 - DNA, 18 bp, Synthetic construct
  source 1..18: mol_type = other DNA
ttataacctgtaaaaacg

SEQ ID NO: 315 - DNA, 18 bp, Synthetic construct
  source 1..18: mol_type = other DNA
ttgcttataactttctcg

SEQ ID NO: 316 - DNA, 18 bp, Synthetic construct
  source 1..18: mol_type = other DNA
ttcatttctgaatagaga

SEQ ID NO: 317 - DNA, 18 bp, Synthetic construct
  source 1..18: mol_type = other DNA
atctttcattttttctcg

SEQ ID NO: 318 - DNA, 18 bp, Synthetic construct
  source 1..18: mol_type = other DNA
gtcaactactttactttt

SEQ ID NO: 319 - DNA, 18 bp, Synthetic construct
  source 1..18: mol_type = other DNA
aagttaaaccatttctcg

SEQ ID NO: 320 - DNA, 18 bp, Synthetic construct
  source 1..18: mol_type = other DNA
taacctgttttcctaatt

SEQ ID NO: 321 - DNA, 18 bp, Synthetic construct
  source 1..18: mol_type = other DNA
tatagaataactttctcg

SEQ ID NO: 322 - DNA, 18 bp, Synthetic construct
  source 1..18: mol_type = other DNA
cccttcctgttgtaattg

SEQ ID NO: 323 - DNA, 18 bp, Synthetic construct
  source 1..18: mol_type = other DNA
accactgaatagagaaaa

SEQ ID NO: 324 - DNA, 18 bp, Synthetic construct
  source 1..18: mol_type = other DNA
acttcctgttgtaattga

SEQ ID NO: 325 - DNA, 18 bp, Synthetic construct
  source 1..18: mol_type = other DNA
atcaccttactagtaaag

SEQ ID NO: 326 - DNA, 18 bp, Synthetic construct
  source 1..18: mol_type = other DNA
ttttatggacttttctcg

SEQ ID NO: 327 - DNA, 18 bp, Synthetic construct
  source 1..18: mol_type = other DNA
tttgctgctgttttctcg

SEQ ID NO: 328 - DNA, 18 bp, Synthetic construct
  source 1..18: mol_type = other DNA
ttcatttctgtaaaaacg

SEQ ID NO: 329 - DNA, 18 bp, Synthetic construct
  source 1..18: mol_type = other DNA
attttcaaagtaggcttc

SEQ ID NO: 330 - DNA, 18 bp, Synthetic construct
  source 1..18: mol_type = other DNA
tattaagaggatgtcagc

SEQ ID NO: 331 - DNA, 18 bp, Synthetic construct
  source 1..18: mol_type = other DNA
aacttactagtaaagtcg

SEQ ID NO: 332 - DNA, 18 bp, Synthetic construct
  source 1..18: mol_type = other DNA
ccagaaggctgtttctcg

SEQ ID NO: 333 - DNA, 18 bp, Synthetic construct
  source 1..18: mol_type = other DNA
ctgtctgaatagagaaaa

SEQ ID NO: 334 - DNA, 18 bp, Synthetic construct
  source 1..18: mol_type = other DNA
ctgctgtctgtaaaaacg

SEQ ID NO: 335 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-MOE 5-methylcytidine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
accccctccagctccgcc

SEQ ID NO: 336 - DNA, 18 bp, Synthetic construct
  source 1..18: mol_type = other DNA
  modified_base 1: mod_base = OTHER; note = 2'-MOE guanosine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7..8: mod_base = OTHER; note = 2'-deoxyguanosine 3'-phosphorothioate
  modified_base 9..13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
gccaacggcccccacgcc

SEQ ID NO: 337 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 5-methyl-2'-deoxycytidine 3'-phosphorothioate
  modified_base 10..11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16..17: mod_base = OTHER; note = 2'-MOE 5-methylcytidine 3'-phosphorothioate
  modified_base 18: mod_base = OTHER; note = 2'-MOE 5-methylcytidine
tctggagccaacggcccc

SEQ ID NO: 338 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9..10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
atttgtctggagccaacg

SEQ ID NO: 339 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3..4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7..9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE 5-methylcytidine
tgtttatttgtctggagc

SEQ ID NO: 340 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9..11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE 5-methylcytidine
actccatgtttatttgtc

SEQ ID NO: 341 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14..15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE thymidine
gatggactccatgtttat

SEQ ID NO: 342 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE guanosine
tggaagatggactccatg

SEQ ID NO: 343 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6..7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9..10: mod_base = OTHER; note = 2'-deoxythymidine 3'-phosphorothioate
  modified_base 11: mod_base = OTHER; note = 2'-deoxyguanosine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
gagccttcttgtttctcg

SEQ ID NO: 344 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 5-methyl-2'-deoxycytidine 3'-phosphorothioate
  modified_base 11..12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
aaagtgagccttcttgtt

SEQ ID NO: 345 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6..8: mod_base = OTHER; note = 2'-deoxyadenosine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE 5-methylcytidine 3'-phosphodiester
  modified_base 16..17: mod_base = OTHER; note = 2'-MOE thymidine 3'-phosphorothioate
  modified_base 18: mod_base = OTHER; note = 2'-MOE 5-methylcytidine
agcacaaagtgagccttc

SEQ ID NO: 346 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9..11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
ttgagcacaaagtgagcc

SEQ ID NO: 347 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7..8: mod_base = OTHER; note = 2'-deoxyadenosine 3'-phosphorothioate
  modified_base 9: mod_base = OTHER; note = 2'-deoxyguanosine 3'-phosphorothioate
  modified_base 10..11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE guanosine
tgcaataagttattcagg

SEQ ID NO: 348 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7..9: mod_base = OTHER; note = 2'-deoxyguanosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE thymidine
tccacagggctaaaatat

SEQ ID NO: 349 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 5-methyl-2'-deoxycytidine 3'-phosphorothioate
  modified_base 11..12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE guanosine
gctgatgtgcaattgagg

SEQ ID NO: 350 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
attctcatcctctcctcc

SEQ ID NO: 351 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8..9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE thymidine
cactagtaactcctcctt

SEQ ID NO: 352 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3..4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
aaggctgctgtaaaaacg

SEQ ID NO: 353 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6..7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
cagaaggctgctgtaaaa

SEQ ID NO: 354 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 2'-deoxyadenosine 3'-phosphorothioate
  modified_base 11..12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE guanosine
atttccagaaggctgctg

SEQ ID NO: 355 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7..9: mod_base = OTHER; note = 2'-deoxythymidine 3'-phosphorothioate
  modified_base 10..11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE adenosine 3'-phosphodiester
  modified_base 16..17: mod_base = OTHER; note = 2'-MOE guanosine 3'-phosphorothioate
  modified_base 18: mod_base = OTHER; note = 2'-MOE 5-methylcytidine
tccatatttccagaaggc

SEQ ID NO: 356 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7..8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE guanosine
tgtcatccatatttccag

SEQ ID NO: 357 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE thymidine
accactgtcatccatatt

SEQ ID NO: 358 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6..7: mod_base = OTHER; note = 2'-deoxyadenosine 3'-phosphorothioate
  modified_base 8..9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12..13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE guanosine
cttataacctgaatagag

SEQ ID NO: 359 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE adenosine 3'-phosphorothioate
  modified_base 6..9: mod_base = OTHER; note = 5-methyl-2'-deoxycytidine 3'-phosphorothioate
  modified_base 10..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
ctaaaccccaaactttca

SEQ ID NO: 360 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..10: mod_base = OTHER; note = 2'-deoxyadenosine 3'-phosphorothioate
  modified_base 11..13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE 5-methylcytidine
tagttctaaaccccaaac

SEQ ID NO: 361 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE 5-methylcytidine
aggattagttctaaaccc

SEQ ID NO: 362 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3..4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7..8: mod_base = OTHER; note = 2'-deoxyguanosine 3'-phosphorothioate
  modified_base 9: mod_base = OTHER; note = 2'-deoxyadenosine 3'-phosphorothioate
  modified_base 10..11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE adenosine
tgaacaggattagttcta

SEQ ID NO: 363 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12..13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE guanosine
actgttgaacaggattag

SEQ ID NO: 364 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10..11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE guanosine
tctggactgttgaacagg

SEQ ID NO: 365 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14..15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
atactctggactgttgaa

SEQ ID NO: 366 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE 5-methylcytidine
ataggatcgatcctgagc

SEQ ID NO: 367 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7..8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE adenosine
ccttataattgcatataa

SEQ ID NO: 368 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8..10: mod_base = OTHER; note = 2'-deoxyadenosine 3'-phosphorothioate
  modified_base 11..12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
taactgtaaaccagtgtt

SEQ ID NO: 369 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6..9: mod_base = OTHER; note = 2'-deoxythymidine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE adenosine
cctaattttctaactgta

SEQ ID NO: 370 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7..10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE thymidine
tcctaattttctaactgt

SEQ ID NO: 371 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 2'-deoxythymidine 3'-phosphorothioate
  modified_base 10..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE guanosine
attcaagttaaaccactg

SEQ ID NO: 372 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10..11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE 5-methylcytidine
agagaattcaagttaaac

SEQ ID NO: 373 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16..17: mod_base = OTHER; note = 2'-MOE thymidine 3'-phosphorothioate
  modified_base 18: mod_base = OTHER; note = 2'-MOE adenosine
aagagagaattcaagtta

SEQ ID NO: 374 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..9: mod_base = OTHER; note = 2'-deoxyguanosine 3'-phosphorothioate
  modified_base 10: mod_base = OTHER; note = 2'-deoxyadenosine 3'-phosphorothioate
  modified_base 11..13: mod_base = OTHER; note = 5-methyl-2'-deoxycytidine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE adenosine
taattctggacccgtcaa

SEQ ID NO: 375 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7..8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE 5-methylcytidine
gatattaattctggaccc

SEQ ID NO: 376 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11..12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
gtatctgatattaattct

SEQ ID NO: 377 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE thymidine 3'-phosphorothioate
  modified_base 18: mod_base = OTHER; note = 2'-MOE adenosine
gatatgtatctgatatta

SEQ ID NO: 378 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 5-methyl-2'-deoxycytidine 3'-phosphorothioate
  modified_base 11..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE guanosine
taattgagccaagaaaag

SEQ ID NO: 379 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
aatatagaataaccttcc

SEQ ID NO: 380 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3'-phosphorothioate
  modified_base 10..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE thymidine
caaatatagaataacctt

SEQ ID NO: 381 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11..13: mod_base = OTHER; note = 5-methyl-2'-deoxycytidine 3'-phosphorothioate
  modified_base 14..15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE 5-methylcytidine
tggcagatcacccttaac

SEQ ID NO: 382 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7..8: mod_base = OTHER; note = 2'-deoxyguanosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE 5-methylcytidine
caatctggcagatcaccc

SEQ ID NO: 383 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3..4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..9: mod_base = OTHER; note = 2'-deoxyguanosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
gcaatctggcagatcacc

SEQ ID NO: 384 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8..9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12..13: mod_base = OTHER; note = 2'-deoxythymidine 3'-phosphorothioate
  modified_base 14..15: mod_base = OTHER; note = 2'-MOE guanosine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
atctgcaggagttggtca

SEQ ID NO: 385 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE 5-methylcytidine
gatgcatctgttggaccc

SEQ ID NO: 386 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12..13: mod_base = OTHER; note = 2'-deoxythymidine 3'-phosphorothioate
  modified_base 14..15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
cgatgcatctgttggacc

SEQ ID NO: 387 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
ttggtcgatgcatctgtt

SEQ ID NO: 388 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8..9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE thymidine
aagttttggtcgatgcat

SEQ ID NO: 389 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE adenosine 3'-phosphodiester
  modified_base 5: mod_base = OTHER; note = 2'-MOE thymidine 3'-phosphorothioate
  modified_base 6..7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE guanosine 3'-phosphorothioate
  modified_base 18: mod_base = OTHER; note = 2'-MOE adenosine
ccaataagttttggtcga

SEQ ID NO: 390 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9..10: mod_base = OTHER; note = 5-methyl-2'-deoxycytidine 3'-phosphorothioate
  modified_base 11..12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
attcttctccaataagtt

SEQ ID NO: 391 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10..13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16..17: mod_base = OTHER; note = 2'-MOE thymidine 3'-phosphorothioate
  modified_base 18: mod_base = OTHER; note = 2'-MOE guanosine
tctttgctcttttagttg

SEQ ID NO: 392 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE guanosine 3'-phosphodiester
  modified_base 3..4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8..9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14..15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE adenosine
cgttccaggtctgtttta

SEQ ID NO: 393 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10..12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
gagccatcatttgcttct

SEQ ID NO: 394 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
aaatcctcctcatcttcg

SEQ ID NO: 395 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10..11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE 5-methylcytidine
gacttagtgccagagccc

SEQ ID NO: 396 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7..8: mod_base = OTHER; note = 2'-deoxythymidine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16..17: mod_base = OTHER; note = 2'-MOE adenosine 3'-phosphorothioate
  modified_base 18: mod_base = OTHER; note = 2'-MOE thymidine
ctcatcttccatgtcaat

SEQ ID NO: 397 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6..7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 5-methyl-2'-deoxycytidine 3'-phosphorothioate
  modified_base 11..12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
atagccctgcggagatct

SEQ ID NO: 398 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6..7: mod_base = OTHER; note = 5-methyl-2'-deoxycytidine 3'-phosphorothioate
  modified_base 8..9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16..17: mod_base = OTHER; note = 2'-MOE thymidine 3'-phosphorothioate
  modified_base 18: mod_base = OTHER; note = 2'-MOE adenosine
aactaccttgcatactta

SEQ ID NO: 399 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE guanosine 3'-phosphodiester
  modified_base 3..4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8..9: mod_base = OTHER; note = 5-methyl-2'-deoxycytidine 3'-phosphorothioate
  modified_base 10..11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
ggaactaccttgcatact

SEQ ID NO: 400 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7..8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
catatcttgagatatgtt

SEQ ID NO: 401 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10..11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE 5-methylcytidine
agatttgtacctgatgtc

SEQ ID NO: 402 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE guanosine
tcttccgaagctcttctg

SEQ ID NO: 403 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10..11: mod_base = OTHER; note = 2'-deoxyguanosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
ttcaaagtaggcttctcg

SEQ ID NO: 404 - DNA, 18 bp, Synthetic construct
  source 1..18: mol_type = other DNA
  modified_base 1: mod_base = OTHER; note = 2'-MOE thymidine 3'-phosphorothioate
  modified_base 2..4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16..17: mod_base = OTHER; note = 2'-MOE thymidine 3'-phosphorothioate
  modified_base 18: mod_base = OTHER; note = 2'-MOE 5-methylcytidine
tttttcaaagtaggcttc

SEQ ID NO: 405 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3..4: mod_base = OTHER; note = 2'-MOE guanosine 3'-phosphodiester
  modified_base 5: mod_base = OTHER; note = 2'-MOE thymidine 3'-phosphorothioate
  modified_base 6..10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE guanosine
taggtccccctgctgctg

SEQ ID NO: 406 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE thymidine
catggatgtgaactctgt

SEQ ID NO: 407 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..9: mod_base = OTHER; note = 2'-deoxyguanosine 3'-phosphorothioate
  modified_base 10: mod_base = OTHER; note = 2'-deoxythymidine 3'-phosphorothioate
  modified_base 11..12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
ctgaactggtggctggcc

SEQ ID NO: 408 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE 5-methylcytidine 3'-phosphodiester
  modified_base 16..17: mod_base = OTHER; note = 2'-MOE adenosine 3'-phosphorothioate
  modified_base 18: mod_base = OTHER; note = 2'-MOE guanosine
acctagatcactcccaag

SEQ ID NO: 409 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6..7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9..10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE adenosine
atgtcttcttcactcata

SEQ ID NO: 410 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE thymidine
acatggtcacagctgcct

SEQ ID NO: 411 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6..7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
gacatggtcacagctgcc

SEQ ID NO: 412 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11..12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE guanosine
ctaaagacatggtcacag

SEQ ID NO: 413 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3..4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16..17: mod_base = OTHER; note = 2'-MOE guanosine 3'-phosphorothioate
  modified_base 18: mod_base = OTHER; note = 2'-MOE thymidine
agtttctaaagacatggt

SEQ ID NO: 414 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE 5-methylcytidine
atcatttctgacagtttc

SEQ ID NO: 415 - DNA, 18 bp, Synthetic construct
  source 1..18: mol_type = other DNA
  modified_base 1: mod_base = OTHER; note = 2'-MOE guanosine 3'-phosphorothioate
  modified_base 2..4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE adenosine
gaaagtatgaatatctaa

SEQ ID NO: 416 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE adenosine
tgtaatcacacaggataa

SEQ ID NO: 417 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3..4: mod_base = OTHER; note = 2'-MOE thymidine 3'-phosphodiester
  modified_base 5: mod_base = OTHER; note = 2'-MOE adenosine 3'-phosphorothioate
  modified_base 6..7: mod_base = OTHER; note = 5-methyl-2'-deoxycytidine 3'-phosphorothioate
  modified_base 8..10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE 5-methylcytidine
cattaccaaagtggaccc

SEQ ID NO: 418 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10..11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = 2'-MOE thymidine 3'-phosphodiester
  modified_base 16..17: mod_base = OTHER; note = 2'-MOE 5-methylcytidine 3'-phosphorothioate
  modified_base 18: mod_base = OTHER; note = 2'-MOE thymidine
ctaaaagtcttatttcct

SEQ ID NO: 419 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7..9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14..15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE guanosine
cactttcccatcattttg

SEQ ID NO: 420 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3..4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8..9: mod_base = OTHER; note = 2'-deoxyadenosine 3'-phosphorothioate
  modified_base 10..11: mod_base = OTHER; note = 5-methyl-2'-deoxycytidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE guanosine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE thymidine
gtcctacaaccgacgcat

SEQ ID NO: 421 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7..9: mod_base = OTHER; note = 2'-deoxythymidine 3'-phosphorothioate
  modified_base 10..11: mod_base = OTHER; note = 2'-deoxyguanosine 3'-phosphorothioate
  modified_base 12..13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
ctaatatttggaagatca

SEQ ID NO: 422 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE 5-methylcytidine
ttaattgctgaatgcctc

SEQ ID NO: 423 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl-2'-deoxycytidine 3'-phosphorothioate
  modified_base 11..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE adenosine
ttgcacactcaaaaaaga

SEQ ID NO: 424 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7..9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
cctaactttagacatgtt

SEQ ID NO: 425 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE adenosine
ctgcaaaaagatccaaga

SEQ ID NO: 426 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3..4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE guanosine
gaggcgagagctaattag

SEQ ID NO: 427 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3..4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
tacctacaagacagaaaa

SEQ ID NO: 428 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE 5-methylcytidine
ctattacatgatgtgagc

SEQ ID NO: 429 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6..7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 2'-deoxyadenosine 3'-phosphorothioate
  modified_base 11: mod_base = OTHER; note = 2'-deoxyguanosine 3'-phosphorothioate
  modified_base 12..13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
tggttaataagaaatgaa

SEQ ID NO: 430 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7..9: mod_base = OTHER; note = 2'-deoxythymidine 3'-phosphorothioate
  modified_base 10..11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE guanosine
agatactttcctgaaagg

SEQ ID NO: 431 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10..11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE guanosine
actattatcaacatcagg

SEQ ID NO: 432 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 5-methyl-2'-deoxycytidine 3'-phosphorothioate
  modified_base 11..12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
ctgttcatccttctagaa

SEQ ID NO: 433 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3..4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12..13: mod_base = OTHER; note = 2'-deoxythymidine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE guanosine
acggtatacagttgaagg

SEQ ID NO: 434 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE 5-methylcytidine
gatcagagaaaacaacac

SEQ ID NO: 435 - DNA, 18 bp, Synthetic construct
  source 1..18: mol_type = other DNA
  modified_base 1: mod_base = OTHER; note = 2'-MOE guanosine 3'-phosphorothioate
  modified_base 2..4: mod_base = OTHER; note = 2'-MOE adenosine 3'-phosphodiester
  modified_base 5: mod_base = OTHER; note = 2'-MOE adenosine 3'-phosphorothioate
  modified_base 6..7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
gaaaaccaggtagcagaa

SEQ ID NO: 436 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7..8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14..15: mod_base = OTHER; note = 2'-MOE guanosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
caaaagaattgtgggaaa

SEQ ID NO: 437 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7..10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE adenosine
cctcagaaaagattacca

SEQ ID NO: 438 - DNA, 18 bp, Synthetic construct
  source 1..18: mol_type = other DNA
  modified_base 1: mod_base = OTHER; note = 2'-MOE guanosine 3'-phosphorothioate
  modified_base 2..4: mod_base = OTHER; note = 2'-MOE adenosine 3'-phosphodiester
  modified_base 5: mod_base = OTHER; note = 2'-MOE thymidine 3'-phosphorothioate
  modified_base 6..7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
gaaataatgatcccatcg

SEQ ID NO: 439 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8..9: mod_base = OTHER; note = 2'-deoxyguanosine 3'-phosphorothioate
  modified_base 10..11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyguanosine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE adenosine
gagtttaggaacgcacca

SEQ ID NO: 440 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 5-methyl-2'-deoxycytidine 3'-phosphorothioate
  modified_base 11..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE adenosine
gtacttgtgcaaggctga

SEQ ID NO: 441 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16..17: mod_base = OTHER; note = 2'-MOE thymidine 3'-phosphorothioate
  modified_base 18: mod_base = OTHER; note = 2'-MOE thymidine
gcacatgctcacacattt

SEQ ID NO: 442 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
gacattcataaagcatct

SEQ ID NO: 443 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6..9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE thymidine
taaggttttgatataagt

SEQ ID NO: 444 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3..4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxyguanosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE adenosine 3'-phosphodiester
  modified_base 16..17: mod_base = OTHER; note = 2'-MOE guanosine 3'-phosphorothioate
  modified_base 18: mod_base = OTHER; note = 2'-MOE guanosine
aaggcgcaggaagaaggg

SEQ ID NO: 445 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7..8: mod_base = OTHER; note = 2'-deoxyguanosine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE guanosine
tcaattggagaagaaagg

SEQ ID NO: 446 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 5-methyl-2'-deoxycytidine 3'-phosphorothioate
  modified_base 10..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE guanosine
atactatgcttctcctag

SEQ ID NO: 447 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10..11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16..17: mod_base = OTHER; note = 2'-MOE thymidine 3'-phosphorothioate
  modified_base 18: mod_base = OTHER; note = 2'-MOE guanosine
ctaacagaaggagacttg

SEQ ID NO: 448 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 2'-deoxyguanosine 3'-phosphorothioate
  modified_base 11: mod_base = OTHER; note = 2'-deoxythymidine 3'-phosphorothioate
  modified_base 12..13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
acattcatggtgggtacg

SEQ ID NO: 449 - DNA, 18 bp, Synthetic construct
  source 1..18: mol_type = other DNA
  modified_base 1: mod_base = OTHER; note = 2'-MOE guanosine 3'-phosphorothioate
  modified_base 2..3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6..7: mod_base = OTHER; note = 5-methyl-2'-deoxycytidine 3'-phosphorothioate
  modified_base 8..10: mod_base = OTHER; note = 2'-deoxyadenosine 3'-phosphorothioate
  modified_base 11..13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE thymidine
gaaggccaaatttcatgt

SEQ ID NO: 450 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3..4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
ctccagtcataggagaaa

SEQ ID NO: 451 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
actcaactgtaaagagaa

SEQ ID NO: 452 - DNA, 18 bp, Synthetic construct
  source 1..18: mol_type = other DNA
  modified_base 1: mod_base = OTHER; note = 2'-MOE guanosine 3'-phosphorothioate
  modified_base 2..3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11..12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE thymidine
gaagcagacacctacatt

SEQ ID NO: 453 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10..11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
caagctatacctactaaa

SEQ ID NO: 454 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6..7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14..15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE 5-methylcytidine
atgttccagatcaccatc

SEQ ID NO: 455 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE 5-methylcytidine
cacagtataaatttaaac

SEQ ID NO: 456 - DNA, 18 bp, Synthetic construct
  source 1..18: mol_type = other DNA
  modified_base 1: mod_base = OTHER; note = 2'-MOE thymidine 3'-phosphorothioate
  modified_base 2..4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE thymidine
taaacatgatgcaagtgt

SEQ ID NO: 457 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3..4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8..9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE guanosine
acttccattgttcttaag

SEQ ID NO: 458 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE adenosine
ttatagatccactaagta

SEQ ID NO: 459 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16..17: mod_base = OTHER; note = 2'-MOE thymidine 3'-phosphorothioate
  modified_base 18: mod_base = OTHER; note = 2'-MOE thymidine
atcaaaactatggacttt

SEQ ID NO: 460 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9..10: mod_base = OTHER; note = 2'-deoxyadenosine 3'-phosphorothioate
  modified_base 11..12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE guanosine
tacatctcaattaaagag

SEQ ID NO: 461 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6..7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3'-phosphorothioate
  modified_base 10: mod_base = OTHER; note = 5-methyl-2'-deoxycytidine 3'-phosphorothioate
  modified_base 11..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
ttgacccagcaagaaact

SEQ ID NO: 462 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7..10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE adenosine
ttcaccaaaatgatacta

SEQ ID NO: 463 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7..8: mod_base = OTHER; note = 2'-deoxyadenosine 3'-phosphorothioate
  modified_base 9..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE 5-methylcytidine
aacatcaatttcagagac

SEQ ID NO: 464 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE adenosine
gatggagaatgagggata

SEQ ID NO: 465 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6..7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE thymidine
caacattcaaaagagctt

SEQ ID NO: 466 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6..8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
tggattttagcttatgaa

SEQ ID NO: 467 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE guanosine 3'-phosphodiester
  modified_base 3..4: mod_base = OTHER; note = 2'-MOE adenosine 3'-phosphodiester
  modified_base 5: mod_base = OTHER; note = 2'-MOE guanosine 3'-phosphorothioate
  modified_base 6..7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 2'-deoxythymidine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
cgaagttgtcagctgaaa

SEQ ID NO: 468 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3..4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE adenosine
gcaatataccatattata

SEQ ID NO: 469 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE adenosine
gtgtgcagccacacacca

SEQ ID NO: 470 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6..8: mod_base = OTHER; note = 2'-deoxythymidine 3'-phosphorothioate
  modified_base 9..11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
aaaactttccctgataaa

SEQ ID NO: 471 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..4: mod_base = OTHER; note = 2'-MOE adenosine 3'-phosphodiester
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9..11: mod_base = OTHER; note = 2'-deoxythymidine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE thymidine
caaaaaactttccctgat

SEQ ID NO: 472 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 5-methyl-2'-deoxycytidine 3'-phosphorothioate
  modified_base 10..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
ttagttagcaataaatcc

SEQ ID NO: 473 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6..9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE adenosine
agctattttataatcata

SEQ ID NO: 474 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
aaaatctgttatatcgaa

SEQ ID NO: 475 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9..12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE adenosine
attggcacaaaataatga

SEQ ID NO: 476 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE guanosine 3'-phosphorothioate
  modified_base 6..7: mod_base = OTHER; note = 2'-deoxyguanosine 3'-phosphorothioate
  modified_base 8..10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
gtaagggaaacttcagaa

SEQ ID NO: 477 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE 5-methylcytidine
ttataattcttctgaaac

SEQ ID NO: 478 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6..7: mod_base = OTHER; note = 5-methyl-2'-deoxycytidine 3'-phosphorothioate
  modified_base 8..9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE adenosine
acatcccttgcagtttta

SEQ ID NO: 479 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
tgagggagtagtactaaa

SEQ ID NO: 480 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
gtcttaaaatatttagct

SEQ ID NO: 481 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7..8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
ggtaataattaacataaa

SEQ ID NO: 482 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6..7: mod_base = OTHER; note = 2'-deoxyguanosine 3'-phosphorothioate
  modified_base 8..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
tccatggaaaatatgaca

SEQ ID NO: 483 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6..8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16..17: mod_base = OTHER; note = 2'-MOE adenosine 3'-phosphorothioate
  modified_base 18: mod_base = OTHER; note = 2'-MOE 5-methylcytidine
tggaaaaaggtaatgaac

SEQ ID NO: 484 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3..4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..10: mod_base = OTHER; note = 2'-deoxythymidine 3'-phosphorothioate
  modified_base 11..12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE 5-methylcytidine
tgaaaagtttaatgtaac

SEQ ID NO: 485 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxyadenosine 3'-phosphorothioate
  modified_base 14..15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE adenosine
ggtagctcatcaattcaa

SEQ ID NO: 486 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6..7: mod_base = OTHER; note = 2'-deoxythymidine 3'-phosphorothioate
  modified_base 8..9: mod_base = OTHER; note = 2'-deoxyguanosine 3'-phosphorothioate
  modified_base 10..13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE thymidine
gcatattggttttctcat

SEQ ID NO: 487 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6..8: mod_base = OTHER; note = 2'-deoxyadenosine 3'-phosphorothioate
  modified_base 9: mod_base = OTHER; note = 2'-deoxyguanosine 3'-phosphorothioate
  modified_base 10..11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE thymidine
actctaaagttaaaactt

SEQ ID NO: 488 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE adenosine
tataaactctaaagttaa

SEQ ID NO: 489 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3..4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14..15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE thymidine
tagggtatatatgaactt

SEQ ID NO: 490 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6..8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10..11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
catattttcttaagtgct

SEQ ID NO: 491 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3..4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
taggaactaaaagtcaaa

SEQ ID NO: 492 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14..15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE guanosine
ccaaacatgatgaaaccg

SEQ ID NO: 493 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..9: mod_base = OTHER; note = 2'-deoxyguanosine 3'-phosphorothioate
  modified_base 10..11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
tctagctggccaggcgca

SEQ ID NO: 494 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
gctcagctctgctttaaa

SEQ ID NO: 495 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7..9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyguanosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE guanosine
acattcaaacgcatccag

SEQ ID NO: 496 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8..9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11..13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
atttcacaacaaactaca

SEQ ID NO: 497 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE guanosine
ggatctgcctgctaaatg

SEQ ID NO: 498 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE guanosine
gatgacagttcactagtg

SEQ ID NO: 499 - DNA, 18 bp, Synthetic construct
  source 1..18: mol_type = other DNA
  modified_base 1: mod_base = OTHER; note = 2'-MOE thymidine 3'-phosphorothioate
  modified_base 2..4: mod_base = OTHER; note = 2'-MOE adenosine 3'-phosphodiester
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11..12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16..17: mod_base = OTHER; note = 2'-MOE 5-methylcytidine 3'-phosphorothioate
  modified_base 18: mod_base = OTHER; note = 2'-MOE 5-methylcytidine
taaatttaagccaacccc

SEQ ID NO: 500 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6..7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE 5-methylcytidine
caattaagaaatggaatc

SEQ ID NO: 501 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6..9: mod_base = OTHER; note = 2'-deoxythymidine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16..17: mod_base = OTHER; note = 2'-MOE guanosine 3'-phosphorothioate
  modified_base 18: mod_base = OTHER; note = 2'-MOE 5-methylcytidine
gcatcttttcatactggc

SEQ ID NO: 502 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3..4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9..12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
ctggcatcttttcatact

SEQ ID NO: 503 - DNA, 18 bp, Synthetic construct
  source 1..18: mol_type = other DNA
  modified_base 1: mod_base = OTHER; note = 2'-MOE thymidine 3'-phosphorothioate
  modified_base 2..4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE 5-methylcytidine
ttttgatactatggttac

SEQ ID NO: 504 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6..8: mod_base = OTHER; note = 2'-deoxythymidine 3'-phosphorothioate
  modified_base 9: mod_base = OTHER; note = 2'-deoxyguanosine 3'-phosphorothioate
  modified_base 10..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE thymidine
atagctttgaataatttt

SEQ ID NO: 505 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE thymidine
tggcagtacctgatgtat

SEQ ID NO: 506 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8..9: mod_base = OTHER; note = 2'-deoxyguanosine 3'-phosphorothioate
  modified_base 10: mod_base = OTHER; note = 2'-deoxythymidine 3'-phosphorothioate
  modified_base 11..12: mod_base = OTHER; note = 2'-deoxyguanosine 3'-phosphorothioate
  modified_base 13: mod_base = OTHER; note = 2'-deoxythymidine 3'-phosphorothioate
  modified_base 14..15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
tcttgcaggtggtttaca

SEQ ID NO: 507 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6..8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11..12: mod_base = OTHER; note = 2'-deoxythymidine 3'-phosphorothioate
  modified_base 13: mod_base = OTHER; note = 2'-deoxyguanosine 3'-phosphorothioate
  modified_base 14..15: mod_base = OTHER; note = 2'-MOE thymidine 3'-phosphodiester
  modified_base 16..17: mod_base = OTHER; note = 2'-MOE 5-methylcytidine 3'-phosphorothioate
  modified_base 18: mod_base = OTHER; note = 2'-MOE thymidine
gtgaatttagttgttcct

SEQ ID NO: 508 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7..8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE guanosine
cacttcttagcaggacag

SEQ ID NO: 509 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6..7: mod_base = OTHER; note = 2'-deoxyadenosine 3'-phosphorothioate
  modified_base 8..9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
ttcccaattagtaaaaca

SEQ ID NO: 510 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE thymidine 3'-phosphorothioate
  modified_base 18: mod_base = OTHER; note = 2'-MOE adenosine
ccaatagtttaaatatta

SEQ ID NO: 511 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14..15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE adenosine
tacaaattatacattaga

SEQ ID NO: 512 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11..12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16..17: mod_base = OTHER; note = 2'-MOE 5-methylcytidine 3'-phosphorothioate
  modified_base 18: mod_base = OTHER; note = 2'-MOE 5-methylcytidine
ctgtacatacttgatccc

SEQ ID NO: 513 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7..8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE thymidine
ttaaacttctactagcat

SEQ ID NO: 514 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 2'-deoxythymidine 3'-phosphorothioate
  modified_base 10..11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
tatgaaagtggtatttcc

SEQ ID NO: 515 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8..9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
attaaatccatgacatct

SEQ ID NO: 516 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3..4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE thymidine
gattaactattctgaatt

SEQ ID NO: 517 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10..11: mod_base = OTHER; note = 2'-deoxyguanosine 3'-phosphorothioate
  modified_base 12..13: mod_base = OTHER; note = 2'-deoxythymidine 3'-phosphorothioate
  modified_base 14..15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE adenosine
tagattgatggttttaga

SEQ ID NO: 518 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
ttacatgattaccgtaaa

SEQ ID NO: 519 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6..8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE adenosine
aacagtttatattactga

SEQ ID NO: 520 - DNA, 18 bp, Synthetic construct
  source 1..18: mol_type = other DNA
  modified_base 1: mod_base = OTHER; note = 2'-MOE guanosine 3'-phosphorothioate
  modified_base 2..4: mod_base = OTHER; note = 2'-MOE thymidine 3'-phosphodiester
  modified_base 5: mod_base = OTHER; note = 2'-MOE adenosine 3'-phosphorothioate
  modified_base 6..7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE thymidine
gtttacctgcagcagcct

SEQ ID NO: 521 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6..7: mod_base = OTHER; note = 5-methyl-2'-deoxycytidine 3'-phosphorothioate
  modified_base 8..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE thymidine
tttggccaagatcctagt

SEQ ID NO: 522 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12..13: mod_base = OTHER; note = 2'-deoxyadenosine 3'-phosphorothioate
  modified_base 14..15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE adenosine
aatattctgtgaattgta

SEQ ID NO: 523 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE adenosine 3'-phosphodiester
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11..12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14..15: mod_base = OTHER; note = 2'-MOE 5-methylcytidine 3'-phosphodiester
  modified_base 16..17: mod_base = OTHER; note = 2'-MOE thymidine 3'-phosphorothioate
  modified_base 18: mod_base = OTHER; note = 2'-MOE adenosine
aaaaaaagcaccacctta

SEQ ID NO: 524 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6..7: mod_base = OTHER; note = 2'-deoxyadenosine 3'-phosphorothioate
  modified_base 8: mod_base = OTHER; note = 2'-deoxythymidine 3'-phosphorothioate
  modified_base 9..11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE adenosine
tcatgaataaagttaaga

SEQ ID NO: 525 - DNA, 18 bp, Synthetic construct
  source 1..18: mol_type = other DNA
  modified_base 1: mod_base = OTHER; note = 2'-MOE guanosine 3'-phosphorothioate
  modified_base 2..4: mod_base = OTHER; note = 2'-MOE thymidine 3'-phosphodiester
  modified_base 5: mod_base = OTHER; note = 2'-MOE thymidine 3'-phosphorothioate
  modified_base 6..8: mod_base = OTHER; note = 2'-deoxythymidine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14..15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE 5-methylcytidine
gtttttttcctcatttac

SEQ ID NO: 526 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16..17: mod_base = OTHER; note = 2'-MOE guanosine 3'-phosphorothioate
  modified_base 18: mod_base = OTHER; note = 2'-MOE thymidine
caatgatactcaactggt

SEQ ID NO: 527 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10..11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE thymidine
tggactactggtagtttt

SEQ ID NO: 528 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE thymidine
tctgactgaaataaaatt

SEQ ID NO: 529 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE thymidine
gacaatcaaaatgtgatt

SEQ ID NO: 530 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14..15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
cactagcatgattttaaa

SEQ ID NO: 531 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyguanosine 3'-phosphorothioate
  modified_base 11..12: mod_base = OTHER; note = 5-methyl-2'-deoxycytidine 3'-phosphorothioate
  modified_base 13: mod_base = OTHER; note = 2'-deoxyadenosine 3'-phosphorothioate
  modified_base 14..15: mod_base = OTHER; note = 2'-MOE guanosine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
tcctctgtcgccagggtt

SEQ ID NO: 532 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14..15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE thymidine
cactagcatgattttttt

SEQ ID NO: 533 - DNA, 18 bp, Synthetic construct
  source 1..18: mol_type = other DNA
  modified_base 1: mod_base = OTHER; note = 2'-MOE thymidine 3'-phosphorothioate
  modified_base 2..4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10..12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE 5-methylcytidine
ttttaagaatttagtagc

SEQ ID NO: 534 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11: mod_base = OTHER; note = 2'-deoxythymidine 3'-phosphorothioate
  modified_base 12..13: mod_base = OTHER; note = 5-methyl-2'-deoxycytidine 3'-phosphorothioate
  modified_base 14..15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE guanosine
tctgtacaggtccaatgg

SEQ ID NO: 535 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE thymidine
ttatgcactgaatctatt

SEQ ID NO: 536 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7..8: mod_base = OTHER; note = 2'-deoxyadenosine 3'-phosphorothioate
  modified_base 9..11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE thymidine
cgtaagaatttaaaacat

SEQ ID NO: 537 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE thymidine 3'-phosphorothioate
  modified_base 18: mod_base = OTHER; note = 2'-MOE guanosine
catcaatattaactattg

SEQ ID NO: 538 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE 5-methylcytidine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6..7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16..17: mod_base = OTHER; note = 2'-MOE 5-methylcytidine 3'-phosphorothioate
  modified_base 18: mod_base = OTHER; note = 2'-MOE thymidine
tgcgattcttagcctcct

SEQ ID NO: 539 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6..7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16..17: mod_base = OTHER; note = 2'-MOE adenosine 3'-phosphorothioate
  modified_base 18: mod_base = OTHER; note = 2'-MOE 5-methylcytidine
cccttggcactctgcaac

SEQ ID NO: 540 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16..17: mod_base = OTHER; note = 2'-MOE guanosine 3'-phosphorothioate
  modified_base 18: mod_base = OTHER; note = 2'-MOE 5-methylcytidine
tgtctcactctgttgggc

SEQ ID NO: 541 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3..4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE adenosine
taggaagtcatatatata

SEQ ID NO: 542 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8..10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
cccgactgggataaagtt

SEQ ID NO: 543 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3..4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6..7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9..10: mod_base = OTHER; note = 2'-deoxythymidine 3'-phosphorothioate
  modified_base 11..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE guanosine
tacctggcttaagttttg

SEQ ID NO: 544 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7..8: mod_base = OTHER; note = 2'-deoxyadenosine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 2'-deoxyguanosine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16..17: mod_base = OTHER; note = 2'-MOE thymidine 3'-phosphorothioate
  modified_base 18: mod_base = OTHER; note = 2'-MOE thymidine
acctttaagatggagttt

SEQ ID NO: 545 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE 5-methylcytidine
tccggattaaaaaaaaac

SEQ ID NO: 546 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9..10: mod_base = OTHER; note = 2'-deoxyguanosine 3'-phosphorothioate
  modified_base 11..13: mod_base = OTHER; note = 5-methyl-2'-deoxycytidine 3'-phosphorothioate
  modified_base 14..15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE guanosine 3'-phosphorothioate
  modified_base 18: mod_base = OTHER; note = 2'-MOE 5-methylcytidine
aaaatagcggcccaacgc

SEQ ID NO: 547 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16..17: mod_base = OTHER; note = 2'-MOE guanosine 3'-phosphorothioate
  modified_base 18: mod_base = OTHER; note = 2'-MOE thymidine
aacaaatattcgccaggt

SEQ ID NO: 548 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7..8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11..12: mod_base = OTHER; note = 5-methyl-2'-deoxycytidine 3'-phosphorothioate
  modified_base 13: mod_base = OTHER; note = 2'-deoxyguanosine 3'-phosphorothioate
  modified_base 14..15: mod_base = OTHER; note = 2'-MOE guanosine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE thymidine
tggcccaaggccgggtgt

SEQ ID NO: 549 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9..10: mod_base = OTHER; note = 2'-deoxyadenosine 3'-phosphorothioate
  modified_base 11..12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16..17: mod_base = OTHER; note = 2'-MOE thymidine 3'-phosphorothioate
  modified_base 18: mod_base = OTHER; note = 2'-MOE thymidine
caacaaacaattcacttt

SEQ ID NO: 550 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10..11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE thymidine
tatccatacttaaggact

SEQ ID NO: 551 - DNA, 18 bp, Synthetic construct
  source 1..18: mol_type = other DNA
  modified_base 1: mod_base = OTHER; note = 2'-MOE guanosine 3'-phosphorothioate
  modified_base 2..3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7..8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE 5-methylcytidine
gttcttaattagggtcac

SEQ ID NO: 552 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE 5-methylcytidine
tgattagttgatccaatc

SEQ ID NO: 553 - DNA, 18 bp, Synthetic construct
  source 1..18: mol_type = other DNA
  modified_base 1: mod_base = OTHER; note = 2'-MOE thymidine 3'-phosphorothioate
  modified_base 2..4: mod_base = OTHER; note = 2'-MOE adenosine 3'-phosphodiester
  modified_base 5: mod_base = OTHER; note = 2'-MOE guanosine 3'-phosphorothioate
  modified_base 6..7: mod_base = OTHER; note = 2'-deoxythymidine 3'-phosphorothioate
  modified_base 8: mod_base = OTHER; note = 2'-deoxyadenosine 3'-phosphorothioate
  modified_base 9..11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE 5-methylcytidine
taaagttatttacattgc

SEQ ID NO: 554 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7..8: mod_base = OTHER; note = 2'-deoxyguanosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE adenosine 3'-phosphodiester
  modified_base 16..17: mod_base = OTHER; note = 2'-MOE guanosine 3'-phosphorothioate
  modified_base 18: mod_base = OTHER; note = 2'-MOE guanosine
gatgctggttataaaggg

SEQ ID NO: 555 - DNA, 18 bp, Synthetic construct
  source 1..18: mol_type = other DNA
  modified_base 1: mod_base = OTHER; note = 2'-MOE guanosine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10..13: mod_base = OTHER; note = 2'-deoxythymidine 3'-phosphorothioate
  modified_base 14..15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
gccaggtcattttttaaa

SEQ ID NO: 556 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9..11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE adenosine
ttattatgtttaagacta

SEQ ID NO: 557 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6..8: mod_base = OTHER; note = 2'-deoxyadenosine 3'-phosphorothioate
  modified_base 9: mod_base = OTHER; note = 2'-deoxyguanosine 3'-phosphorothioate
  modified_base 10: mod_base = OTHER; note = 5-methyl-2'-deoxycytidine 3'-phosphorothioate
  modified_base 11..13: mod_base = OTHER; note = 2'-deoxyadenosine 3'-phosphorothioate
  modified_base 14..15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE adenosine
tcatgaaagcaaattaga

SEQ ID NO: 558 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE 5-methylcytidine
ccaacgatgtcaataatc

SEQ ID NO: 559 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8..9: mod_base = OTHER; note = 2'-deoxythymidine 3'-phosphorothioate
  modified_base 10..11: mod_base = OTHER; note = 2'-deoxyguanosine 3'-phosphorothioate
  modified_base 12..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE thymidine
agaccacttggaaaaaat

SEQ ID NO: 560 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9..10: mod_base = OTHER; note = 2'-deoxyadenosine 3'-phosphorothioate
  modified_base 11..12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
ttagcactaattcttaaa

SEQ ID NO: 561 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8..10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16..17: mod_base = OTHER; note = 2'-MOE thymidine 3'-phosphorothioate
  modified_base 18: mod_base = OTHER; note = 2'-MOE adenosine
cgacaaatttagaagtta

SEQ ID NO: 562 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8..9: mod_base = OTHER; note = 2'-deoxythymidine 3'-phosphorothioate
  modified_base 10..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
tatgctattaaacatgcc

SEQ ID NO: 563 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6..7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9..10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
ccacaggcttaaaatgtt

SEQ ID NO: 564 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 5-methyl-2'-deoxycytidine 3'-phosphorothioate
  modified_base 11..13: mod_base = OTHER; note = 2'-deoxythymidine 3'-phosphorothioate
  modified_base 14: mod_base = OTHER; note = 2'-MOE guanosine 3'-phosphodiester
  modified_base 15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE adenosine
ttctcattgctttgtcta

SEQ ID NO: 565 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE thymidine
aggaatatccatttatat

SEQ ID NO: 566 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 5-methyl-2'-deoxycytidine 3'-phosphorothioate
  modified_base 10..11: mod_base = OTHER; note = 2'-deoxythymidine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE thymidine
attgagagcttcctaaat

SEQ ID NO: 567 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16..17: mod_base = OTHER; note = 2'-MOE adenosine 3'-phosphorothioate
  modified_base 18: mod_base = OTHER; note = 2'-MOE guanosine
ttccttgaactatgcaag

SEQ ID NO: 568 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE adenosine
attagataatcacattta

SEQ ID NO: 569 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16..17: mod_base = OTHER; note = 2'-MOE thymidine 3'-phosphorothioate
  modified_base 18: mod_base = OTHER; note = 2'-MOE guanosine
cctaatagcccagtgttg

SEQ ID NO: 570 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14..15: mod_base = OTHER; note = 2'-MOE adenosine 3'-phosphodiester
  modified_base 16..17: mod_base = OTHER; note = 2'-MOE thymidine 3'-phosphorothioate
  modified_base 18: mod_base = OTHER; note = 2'-MOE thymidine
tatacagaacagtaattt

SEQ ID NO: 571 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8..9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE adenosine
tctgtacttgaatttcaa

SEQ ID NO: 572 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE guanosine
aaacaacaatgctttttg

SEQ ID NO: 573 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11..12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
cacagtgcacttgtatca

SEQ ID NO: 574 - DNA, 18 bp, Synthetic construct
  source 1..18: mol_type = other DNA
  modified_base 1: mod_base = OTHER; note = 2'-MOE guanosine 3'-phosphorothioate
  modified_base 2..3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16..17: mod_base = OTHER; note = 2'-MOE guanosine 3'-phosphorothioate
  modified_base 18: mod_base = OTHER; note = 2'-MOE 5-methylcytidine
gggtcctgagcaagcggc

SEQ ID NO: 575 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 2'-deoxyadenosine 3'-phosphorothioate
  modified_base 11..13: mod_base = OTHER; note = 2'-deoxyguanosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
acacacagaagggctgca

SEQ ID NO: 576 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3..4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11..12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE 5-methylcytidine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE guanosine
gcaaatgaacttaacgag

SEQ ID NO: 577 - DNA, 18 bp, Synthetic construct
  source 1..18: mol_type = other DNA
  modified_base 1: mod_base = OTHER; note = 2'-MOE guanosine 3'-phosphorothioate
  modified_base 2..3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6..7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE adenosine
gaaggcctgtgtgtgtaa

SEQ ID NO: 578 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6..8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16..17: mod_base = OTHER; note = 2'-MOE 5-methylcytidine 3'-phosphorothioate
  modified_base 18: mod_base = OTHER; note = 2'-MOE adenosine
cggcttttctaacgacca

SEQ ID NO: 579 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 2'-deoxyguanosine 3'-phosphorothioate
  modified_base 7..8: mod_base = OTHER; note = 2'-deoxyadenosine 3'-phosphorothioate
  modified_base 9: mod_base = OTHER; note = 2'-deoxyguanosine 3'-phosphorothioate
  modified_base 10..12: mod_base = OTHER; note = 5-methyl-2'-deoxycytidine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16..17: mod_base = OTHER; note = 2'-MOE thymidine 3'-phosphorothioate
  modified_base 18: mod_base = OTHER; note = 2'-MOE thymidine
ctttggaagcccggcttt

SEQ ID NO: 580 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3..4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6..7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE guanosine
tgttcaacagtgctttgg

SEQ ID NO: 581 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9..10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
tccacactaacaacagaa

SEQ ID NO: 582 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8..10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE adenosine
aataatctttgatattta

SEQ ID NO: 583 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 5-methyl-2'-deoxycytidine 3'-phosphorothioate
  modified_base 8..9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE thymidine
gcattgcttataacctgt

SEQ ID NO: 584 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3..4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8..10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE guanosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE thymidine
acttttcaaagtaggctt

SEQ ID NO: 585 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7..9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxythymidine 3'-phosphorothioate
  modified_base 14..15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE adenosine 3'-phosphorothioate
  modified_base 18: mod_base = OTHER; note = 2'-MOE adenosine
aactactttacttttcaa

SEQ ID NO: 586 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE thymidine
tggaagagccgtctcatt

SEQ ID NO: 587 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7..8: mod_base = OTHER; note = 2'-deoxyadenosine 3'-phosphorothioate
  modified_base 9: mod_base = OTHER; note = 2'-deoxyguanosine 3'-phosphorothioate
  modified_base 10..11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE thymidine 3'-phosphodiester
  modified_base 16..17: mod_base = OTHER; note = 2'-MOE adenosine 3'-phosphorothioate
  modified_base 18: mod_base = OTHER; note = 2'-MOE adenosine
taaggtaagttacttaaa

SEQ ID NO: 588 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10..13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16..17: mod_base = OTHER; note = 2'-MOE thymidine 3'-phosphorothioate
  modified_base 18: mod_base = OTHER; note = 2'-MOE guanosine
cctttgctcttttagttg

SEQ ID NO: 589 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3..4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE guanosine
ccttcatctacttctgag

SEQ ID NO: 590 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE adenosine
gatgtcagctgatcagaa

SEQ ID NO: 591 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE thymidine
aagaggatgtcagctgat

SEQ ID NO: 592 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE guanosine 3'-phosphodiester
  modified_base 3..4: mod_base = OTHER; note = 2'-MOE 5-methylcytidine 3'-phosphodiester
  modified_base 5: mod_base = OTHER; note = 2'-MOE guanosine 3'-phosphorothioate
  modified_base 6..7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE 5-methylcytidine 3'-phosphodiester
  modified_base 15: mod_base = OTHER; note = 2'-MOE guanosine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
cgccgggcgagatcggca

SEQ ID NO: 593 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6..7: mod_base = OTHER; note = 2'-deoxyadenosine 3'-phosphorothioate
  modified_base 8: mod_base = OTHER; note = 2'-deoxythymidine 3'-phosphorothioate
  modified_base 9..13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE thymidine
cccgtaataaaaactctt

SEQ ID NO: 594 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 5-methyl-2'-deoxycytidine 3'-phosphorothioate
  modified_base 9..11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
ctaaaaacaaagctggcc

SEQ ID NO: 595 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE adenosine
atagcattactatttgta

SEQ ID NO: 596 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7..8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE thymidine
cagatgttctacttatat

SEQ ID NO: 597 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE 5-methylcytidine 3'-phosphorothioate
  modified_base 18: mod_base = OTHER; note = 2'-MOE adenosine
ttaacataggtacatgca

SEQ ID NO: 598 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 5-methyl-2'-deoxycytidine 3'-phosphorothioate
  modified_base 10..11: mod_base = OTHER; note = 2'-deoxythymidine 3'-phosphorothioate
  modified_base 12: mod_base = OTHER; note = 5-methyl-2'-deoxycytidine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE adenosine
aagtgagccttcttgcta

SEQ ID NO: 599 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14..15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
aatcagtacctgtaaaaa

SEQ ID NO: 600 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7..8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
ttccagaaggctgctgtt

SEQ ID NO: 601 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE guanosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11..13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE guanosine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE guanosine
aaaggctgtgaaacggtg

SEQ ID NO: 602 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE guanosine
aaaaatctagtactctag

SEQ ID NO: 603 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE guanosine 3'-phosphorothioate
  modified_base 6: mod_base = OTHER; note = 2'-deoxyguanosine 3'-phosphorothioate
  modified_base 7..10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE 5-methylcytidine
agctggttttcaataacc

SEQ ID NO: 604 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3..4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7..8: mod_base = OTHER; note = 2'-deoxyadenosine 3'-phosphorothioate
  modified_base 9..10: mod_base = OTHER; note = 5-methyl-2'-deoxycytidine 3'-phosphorothioate
  modified_base 11..12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14..15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE guanosine
agaaagaaccaacttagg

SEQ ID NO: 605 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7..9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE 5-methylcytidine
atttaacccacaagatac

SEQ ID NO: 606 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14..15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE thymidine
catgcagctcatgcctat

SEQ ID NO: 607 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6..8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16..17: mod_base = OTHER; note = 2'-MOE guanosine 3'-phosphorothioate
  modified_base 18: mod_base = OTHER; note = 2'-MOE 5-methylcytidine
tcactaaattagctgggc

SEQ ID NO: 608 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE adenosine
aagttagtgtatattata

SEQ ID NO: 609 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3'-phosphorothioate
  modified_base 10..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
tctcagcagaatgtaacg

SEQ ID NO: 610 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8..9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE adenosine
aactagtaacatggctaa

SEQ ID NO: 611 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7..8: mod_base = OTHER; note = 2'-deoxyadenosine 3'-phosphorothioate
  modified_base 9: mod_base = OTHER; note = 2'-deoxythymidine 3'-phosphorothioate
  modified_base 10..11: mod_base = OTHER; note = 2'-deoxyadenosine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
atatagaataacctaaaa

SEQ ID NO: 612 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3..4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7..9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE thymidine 3'-phosphorothioate
  modified_base 17: mod_base = OTHER; note = 2'-MOE adenosine 3'-phosphorothioate
  modified_base 18: mod_base = OTHER; note = 2'-MOE adenosine
aaggcatttgtaatgtaa

SEQ ID NO: 613 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10..12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE thymidine
accaactactttactttt

SEQ ID NO: 614 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3..4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8..9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE guanosine
tgcccgtcctatttgctg

SEQ ID NO: 615 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3..4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6..7: mod_base = OTHER; note = 2'-deoxyadenosine 3'-phosphorothioate
  modified_base 8..10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE 5-methylcytidine
gtcctaatttcatttttc

SEQ ID NO: 616 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxythymidine 3'-phosphorothioate
  modified_base 14..15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
tgagttgtgacttaaaaa

SEQ ID NO: 617 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE adenosine 3'-phosphodiester
  modified_base 3..4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE 5-methylcytidine
cattaagaggatgtcagc

SEQ ID NO: 618 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE 5-methylcytidine 3'-phosphodiester
  modified_base 3: mod_base = OTHER; note = 2'-MOE thymidine 3'-phosphodiester
  modified_base 4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxyadenosine 3'-phosphorothioate
  modified_base 8..9: mod_base = OTHER; note = 2'-deoxythymidine 3'-phosphorothioate
  modified_base 10..11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14..15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE guanosine
tctcacattaagaggatg

SEQ ID NO: 619 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl-2'-deoxycytidine 3'-phosphorothioate
  modified_base 10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE adenosine
aaatatctcacattaaga

SEQ ID NO: 620 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3..4: mod_base = OTHER; note = 2'-MOE 5-methylcytidine 3'-phosphodiester
  modified_base 5: mod_base = OTHER; note = 2'-MOE adenosine 3'-phosphorothioate
  modified_base 6..7: mod_base = OTHER; note = 2'-deoxythymidine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 5-methyl-2'-deoxycytidine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE 5-methylcytidine 3'-phosphorothioate
  modified_base 17: mod_base = OTHER; note = 2'-MOE thymidine 3'-phosphorothioate
  modified_base 18: mod_base = OTHER; note = 2'-MOE guanosine
agccattaatctatactg

SEQ ID NO: 621 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..10: mod_base = OTHER; note = 2'-deoxyadenosine 3'-phosphorothioate
  modified_base 11..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE guanosine 3'-phosphodiester
  modified_base 16: mod_base = OTHER; note = 2'-MOE guanosine 3'-phosphorothioate
  modified_base 17: mod_base = OTHER; note = 2'-MOE adenosine 3'-phosphorothioate
  modified_base 18: mod_base = OTHER; note = 2'-MOE thymidine
agatttgaaattttggat

SEQ ID NO: 622 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9..10: mod_base = OTHER; note = 2'-deoxythymidine 3'-phosphorothioate
  modified_base 11..12: mod_base = OTHER; note = 2'-deoxyguanosine 3'-phosphorothioate
  modified_base 13: mod_base = OTHER; note = 2'-deoxythymidine 3'-phosphorothioate
  modified_base 14..15: mod_base = OTHER; note = 2'-MOE thymidine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE adenosine
aatgagtgttggtttata

SEQ ID NO: 623 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 5-methyl-2'-deoxycytidine 3'-phosphorothioate
  modified_base 14: mod_base = OTHER; note = 2'-MOE 5-methylcytidine 3'-phosphodiester
  modified_base 15: mod_base = OTHER; note = 2'-MOE adenosine 3'-phosphodiester
  modified_base 16: mod_base = OTHER; note = 2'-MOE guanosine 3'-phosphorothioate
  modified_base 17: mod_base = OTHER; note = 2'-MOE thymidine 3'-phosphorothioate
  modified_base 18: mod_base = OTHER; note = 2'-MOE thymidine
tagaaaaaagtaccagtt

SEQ ID NO: 624 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxyadenosine 3'-phosphorothioate
  modified_base 7..8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 2'-deoxythymidine 3'-phosphorothioate
  modified_base 13: mod_base = OTHER; note = 2'-deoxyguanosine 3'-phosphorothioate
  modified_base 14..15: mod_base = OTHER; note = 2'-MOE guanosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
gcatcacctgttgggaaa

SEQ ID NO: 625 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..11: mod_base = OTHER; note = 2'-deoxythymidine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE thymidine
ctgtctgttttcctaatt

SEQ ID NO: 626 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE 5-methylcytidine 3'-phosphodiester
  modified_base 3: mod_base = OTHER; note = 2'-MOE adenosine 3'-phosphodiester
  modified_base 4: mod_base = OTHER; note = 2'-MOE guanosine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7..8: mod_base = OTHER; note = 2'-deoxyguanosine 3'-phosphorothioate
  modified_base 9: mod_base = OTHER; note = 5-methyl-2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
ccagaaggctgtttctcg

SEQ ID NO: 627 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7..8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
ttataacctgtaaaaacg

SEQ ID NO: 628 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
ttgcttataactttctcg

SEQ ID NO: 629 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE adenosine
ttcatttctgaatagaga

SEQ ID NO: 630 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl-2'-deoxycytidine 3'-phosphorothioate
  modified_base 8: mod_base = OTHER; note = 2'-deoxyadenosine 3'-phosphorothioate
  modified_base 9..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
atctttcattttttctcg

SEQ ID NO: 631 - DNA, 18 bp, Synthetic construct
  source 1..18: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 5-methyl-2'-deoxycytidine 3'-phosphorothioate
  modified_base 10..12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE 5-methylcytidine 3'-phosphodiester
  modified_base 15: mod_base = OTHER; note = 2'-MOE thymidine 3'-phosphodiester
  modified_base 16..17: mod_base = OTHER; note = 2'-MOE thymidine 3'-phosphorothioate
  modified_base 18: mod_base = OTHER; note = 2'-MOE thymidine
gtcaactactttactttt

SEQ ID NO: 632 - DNA, 18 bp, Synthetic construct
  source 1..18: mol_type = other DNA
  modified_base 1: mod_base = OTHER; note = 2'-MOE adenosine 3'-phosphorothioate
  modified_base 2..3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
accactgaatagagaaaa

SEQ ID NO: 633 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6..8: mod_base = OTHER; note = 2'-deoxyadenosine 3'-phosphorothioate
  modified_base 9..10: mod_base = OTHER; note = 5-methyl-2'-deoxycytidine 3'-phosphorothioate
  modified_base 11: mod_base = OTHER; note = 2'-deoxyadenosine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
aagttaaaccatttctcg

SEQ ID NO: 634 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE adenosine 3'-phosphodiester
  modified_base 4: mod_base = OTHER; note = 2'-MOE 5-methylcytidine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..11: mod_base = OTHER; note = 2'-deoxythymidine 3'-phosphorothioate
  modified_base 12..13: mod_base = OTHER; note = 5-methyl-2'-deoxycytidine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE thymidine 3'-phosphorothioate
  modified_base 18: mod_base = OTHER; note = 2'-MOE thymidine
taacctgttttcctaatt

SEQ ID NO: 635 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE guanosine 3'-phosphorothioate
  modified_base 6..7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 2'-deoxyadenosine 3'-phosphorothioate
  modified_base 11: mod_base = OTHER; note = 5-methyl-2'-deoxycytidine 3'-phosphorothioate
  modified_base 12..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
tatagaataactttctcg

SEQ ID NO: 636 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2..3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6..7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10..11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14..15: mod_base = OTHER; note = 2'-MOE adenosine 3'-phosphodiester
  modified_base 16..17: mod_base = OTHER; note = 2'-MOE thymidine 3'-phosphorothioate
  modified_base 18: mod_base = OTHER; note = 2'-MOE guanosine
cccttcctgttgtaattg

SEQ ID NO: 637 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE 5-methylcytidine 3'-phosphodiester
  modified_base 3..4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9..10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE thymidine 3'-phosphodiester
  modified_base 16: mod_base = OTHER; note = 2'-MOE thymidine 3'-phosphorothioate
  modified_base 17: mod_base = OTHER; note = 2'-MOE guanosine 3'-phosphorothioate
  modified_base 18: mod_base = OTHER; note = 2'-MOE adenosine
acttcctgttgtaattga

SEQ ID NO: 638 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE 5-methylcytidine 3'-phosphorothioate
  modified_base 6: mod_base = OTHER; note = 5-methyl-2'-deoxycytidine 3'-phosphorothioate
  modified_base 7..8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE guanosine
atcaccttactagtaaag

SEQ ID NO: 639 - DNA, 18 bp, Synthetic construct
  source 1..18: mol_type = other DNA
  modified_base 1: mod_base = OTHER; note = 2'-MOE thymidine 3'-phosphorothioate
  modified_base 2..4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7..8: mod_base = OTHER; note = 2'-deoxyguanosine 3'-phosphorothioate
  modified_base 9: mod_base = OTHER; note = 2'-deoxyadenosine 3'-phosphorothioate
  modified_base 10: mod_base = OTHER; note = 5-methyl-2'-deoxycytidine 3'-phosphorothioate
  modified_base 11..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
ttttatggacttttctcg

SEQ ID NO: 640 - DNA, 18 bp, Synthetic construct
  source 1..18: mol_type = other DNA
  modified_base 1: mod_base = OTHER; note = 2'-MOE thymidine 3'-phosphorothioate
  modified_base 2..3: mod_base = OTHER; note = 2'-MOE thymidine 3'-phosphodiester
  modified_base 4: mod_base = OTHER; note = 2'-MOE guanosine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11..13: mod_base = OTHER; note = 2'-deoxythymidine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
tttgctgctgttttctcg

SEQ ID NO: 641 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methylcytidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
ttcatttctgtaaaaacg

SEQ ID NO: 642 - DNA, 18 bp, Synthetic construct
  source 1..18: mol_type = other DNA
  modified_base 1: mod_base = OTHER; note = 2'-MOE adenosine 3'-phosphorothioate
  modified_base 2..4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl-2'-deoxycytidine 3'-phosphorothioate
  modified_base 7..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-MOE guanosine 3'-phosphodiester
  modified_base 15: mod_base = OTHER; note = 2'-MOE 5-methylcytidine 3'-phosphodiester
  modified_base 16..17: mod_base = OTHER; note = 2'-MOE thymidine 3'-phosphorothioate
  modified_base 18: mod_base = OTHER; note = 2'-MOE 5-methylcytidine
attttcaaagtaggcttc

SEQ ID NO: 643 - DNA, 18 bp, Synthetic construct
  source 1..18: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3..4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-MOE thymidine 3'-phosphodiester
  modified_base 15: mod_base = OTHER; note = 2'-MOE 5-methylcytidine 3'-phosphodiester
  modified_base 16: mod_base = OTHER; note = 2'-MOE adenosine 3'-phosphorothioate
  modified_base 17: mod_base = OTHER; note = 2'-MOE guanosine 3'-phosphorothioate
  modified_base 18: mod_base = OTHER; note = 2'-MOE 5-methylcytidine
tattaagaggatgtcagc

SEQ ID NO: 644 - DNA, 18 bp, Synthetic construct
  source 1..18: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE 5-methylcytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 5-methyl-2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14: mod_base = OTHER; note = 2'-MOE adenosine 3'-phosphodiester
  modified_base 15: mod_base = OTHER; note = 2'-MOE guanosine 3'-phosphodiester
  modified_base 16: mod_base = OTHER; note = 2'-MOE thymidine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
aacttactagtaaagtcg

SEQ ID NO: 645 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphodiester
  modified_base 5: mod_base = OTHER; note = 2'-MOE 5-methylcytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-MOE guanosine 3'-phosphodiester
  modified_base 15: mod_base = OTHER; note = 2'-MOE adenosine 3'-phosphodiester
  modified_base 16..17: mod_base = OTHER; note = 2'-MOE adenosine 3'-phosphorothioate
  modified_base 18: mod_base = OTHER; note = 2'-MOE adenosine
ctgtctgaatagagaaaa

SEQ ID NO: 646 - DNA, 18 bp, Synthetic construct
  source 1..18: mol_type = other DNA
  modified_base 1: mod_base = OTHER; note = 2'-MOE 5-methylcytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphodiester
  modified_base 4: mod_base = OTHER; note = 2'-MOE 5-methylcytidine 3'-phosphodiester
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 5-methyl-2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-MOE adenosine 3'-phosphodiester
  modified_base 16: mod_base = OTHER; note = 2'-MOE adenosine 3'-phosphorothioate
  modified_base 17: mod_base = OTHER; note = 2'-MOE 5-methylcytidine 3'-phosphorothioate
  modified_base 18: mod_base = OTHER; note = 2'-MOE guanosine
ctgctgtctgtaaaaacg

The invention claimed is:

1. An oligomeric compound comprising a modified oligonucleotide consisting of 12-20 linked nucleosides and having a nucleobase sequence comprising at least 12, at least 13, at least 14, at least 15, or at least 16 contiguous nucleobases of any of SEQ ID NO: 73-75, wherein the modified oligonucleotide has a sugar motif comprising:
    a 5'-region consisting of 1-5 linked 5'-nucleosides;
    a central region consisting of 6-10 linked central region nucleosides; and
    a 3'-region consisting of 1-5 linked 3'-region nucleosides; and
    wherein each of the 5'-region nucleosides and each of the 3'-region nucleosides comprises a modified sugar moiety and each of the central region nucleosides comprises an unmodified DNA sugar moiety.

2. The oligomeric compound of claim 1, wherein the modified oligonucleotide has a nucleobase sequence that is at least 80%, 85%, 90%, 95%, or 100% complementary to the nucleobase sequence of SEQ ID NO: 1, when measured across the entire nucleobase sequence of the modified oligonucleotide.

3. The oligomeric compound of claim 1, wherein the modified oligonucleotide comprises at least one modified nucleoside comprising a bicyclic sugar moiety.

4. The oligomeric compound of claim 3, wherein the bicyclic sugar moiety has a 2'-4' bridge, wherein the 2'-4' bridge is —O—CH$_2$— or —O—CH(CH$_3$)—.

5. The oligomeric compound of claim 1, wherein the modified oligonucleotide comprises at least one modified nucleoside comprising a modified non-bicyclic sugar moiety.

6. The oligomeric compound of claim 5, wherein the non-bicyclic sugar moiety comprises a 20'-OCH$_2$CH$_2$ OCH$_3$ (2'-MOE) or a 2'-OCH$_3$ (2'-OMe).

7. The oligomeric compound of claim 1, wherein the modified oligonucleotide comprises at least one modified nucleoside comprising a sugar surrogate selected from morpholino and PNA.

8. The oligomeric compound of claim 1, wherein the modified oligonucleotide comprises at least one modified internucleoside linkage.

9. The oligomeric compound of claim 8, wherein at least one internucleoside linkage is a phosphorothioate internucleoside linkage.

10. The oligomeric compound of claim 8, wherein the modified oligonucleotide comprises at least one phosphodiester internucleoside linkage.

11. The oligomeric compound of claim 8, wherein each internucleoside linkage is either a phosphodiester internucleoside linkage or a phosphorothioate internucleoside linkage.

12. The oligomeric compound of claim 1, wherein the modified oligonucleotide comprises at least one modified nucleobase.

13. The oligomeric compound of claim 12, wherein the modified nucleobase is a 5-methylcytosine.

14. The oligomeric compound of claim 1, wherein the modified oligonucleotide consists of 12-20, 14-20, 16-20, or 18-20 linked nucleosides.

15. The oligomeric compound of claim 1, comprising a conjugate group comprising a conjugate moiety and a conjugate linker.

16. The oligomeric compound of claim 1, wherein the oligomeric compound is a single-stranded oligomeric compound.

17. An oligomeric duplex comprising a first oligomeric compound comprising a modified oligonucleotide consisting of 12-30 linked nucleosides and having a nucleobase sequence comprising at least 12, at least 13, at least 14, at least 15, or at least 16 contiguous nucleobases of any of SEQ ID NO: 73-75, wherein the modified oligonucleotide comprises at least one modification selected from a modified sugar moiety and a modified internucleoside linkage; and a second oligomeric compound having a region at least 90% complementary to the first oligomeric compound.

18. A modified oligonucleotide consisting of 12-20 linked nucleosides and having a nucleobase sequence comprising at least 12, at least 13, at least 14, at least 15, or at least 16 contiguous nucleobases of any of SEQ ID NO: 73-75, wherein the modified oligonucleotide has a sugar motif comprising:
    a 5'-region consisting of 1-5 linked 5'-nucleosides;
    a central region consisting of 6-10 linked central region nucleosides; and
    a 3'-region consisting of 1-5 linked 3'-region nucleosides; and
    wherein each of the 5'-region nucleosides and each of the 3'-region nucleosides comprises a modified sugar moiety and each of the central region nucleosides comprises an unmodified DNA sugar moiety.

19. An oligomeric compound comprising a modified oligonucleotide consisting of 8-20 linked nucleosides and having a nucleobase sequence comprising a portion of at least 8, at least 9, at least 10, at least 11, at least 12, at least 13, or at least 14 contiguous nucleobases 100% complementary to an equal length portion of nucleobases 614-637 of SEQ ID NO: 1, wherein the nucleobase sequence of the modified oligonucleotide is at least 90% complementary to SEQ ID NO: 1 as measured over the entirety of the modified oligonucleotide, wherein the modified oligonucleotide has a sugar motif comprising:

a 5'-region consisting of 1-5 linked 5'-nucleosides;

a central region consisting of 6-10 linked central region nucleosides; and a 3'-region consisting of 1-5 linked 3'-region nucleosides; and wherein each of the 5'-region nucleosides and each of the 3'-region nucleosides comprises a modified sugar moiety and each of the central region nucleosides comprises an unmodified DNA sugar moiety.

20. A pharmaceutical composition comprising an oligomeric compound of claim 1 and a pharmaceutically acceptable carrier or diluent.

21. A chirally enriched population of oligomeric compounds of claim 1, wherein all of the phosphorothioate internucleoside linkages of the modified oligonucleotide are stereorandom.

\* \* \* \* \*

UNITED STATES PATENT AND TRADEMARK OFFICE
CERTIFICATE OF CORRECTION

Page 1 of 1

PATENT NO. : 12,350,285 B2
APPLICATION NO. : 18/168004
DATED : July 8, 2025
INVENTOR(S) : Susan M. Freier et al.

It is certified that error appears in the above-identified patent and that said Letters Patent is hereby corrected as shown below:

In the Claims

Column 55, In Claim 6, Line 66 should read:
-- non-bicyclic sugar moiety comprises a 2'-$OCH_2CH_2OCH_3$ --

Signed and Sealed this
Fourth Day of November, 2025

John A. Squires
*Director of the United States Patent and Trademark Office*